US009624268B2

(12) United States Patent
Bourne et al.

(10) Patent No.: US 9,624,268 B2
(45) Date of Patent: Apr. 18, 2017

(54) ORAL PEPTIDE INHIBITORS OF INTERLEUKIN-23 RECEPTOR AND THEIR USE TO TREAT INFLAMMATORY BOWEL DISEASES

(71) Applicant: Protagonist Therapeutics, Inc., Milpitas, CA (US)

(72) Inventors: Gregory Thomas Bourne, Jindalee (AU); Ashok Bhandari, Pleasanton, CA (US); Xiaoli Cheng, Mountain View, CA (US); Brian Troy Frederick, Ben Lomond, CA (US); Jie Zhang, Salisbury (AU); Dinesh V. Patel, Fremont, CA (US); David Liu, Milpitas, CA (US)

(73) Assignee: Protagonist Therapeutics, Inc., Milpitas, CA (US)

( * ) Notice: Subject to any disclaimer, the term of this patent is extended or adjusted under 35 U.S.C. 154(b) by 0 days.

(21) Appl. No.: 14/800,627

(22) Filed: Jul. 15, 2015

(65) Prior Publication Data
US 2016/0145306 A1 May 26, 2016

Related U.S. Application Data

(60) Provisional application No. 62/119,688, filed on Feb. 23, 2015, provisional application No. 62/119,685, filed on Feb. 23, 2015, provisional application No. 62/025,899, filed on Jul. 17, 2014.

(51) Int. Cl.
| | |
|---|---|
| *C07K 7/08* | (2006.01) |
| *C07K 14/47* | (2006.01) |
| *C07K 14/54* | (2006.01) |
| *C07K 7/02* | (2006.01) |
| *C07K 7/06* | (2006.01) |
| *C07K 7/50* | (2006.01) |
| *C07K 7/64* | (2006.01) |
| *A61K 38/00* | (2006.01) |

(52) U.S. Cl.
CPC ............... *C07K 7/08* (2013.01); *C07K 7/02* (2013.01); *C07K 7/50* (2013.01); *C07K 7/64* (2013.01); *A61K 38/00* (2013.01); *G01N 2800/065* (2013.01)

(58) Field of Classification Search
CPC .......... A61K 38/00; C07K 7/08; C07K 14/47; C07K 14/54; C07K 14/7155; C07K 7/02; C07K 7/06; C07K 7/50; C07K 7/64
USPC ......... 514/13.2, 21.1, 21.4, 21.5, 21.6, 21.7, 514/21.8; 530/321, 323, 326, 327, 328, 530/329
See application file for complete search history.

(56) References Cited

U.S. PATENT DOCUMENTS

| | | | |
|---|---|---|---|
| 4,684,620 A | 8/1987 | Hruby et al. | |
| 5,990,084 A | 11/1999 | Richter et al. | |
| 6,235,711 B1 | 5/2001 | Dutta | |
| 6,818,617 B1 | 11/2004 | Niewiarowski et al. | |
| 8,536,140 B2 | 9/2013 | Clandinin et al. | |
| 8,796,418 B2 | 8/2014 | Walensky et al. | |
| 8,946,150 B2 | 2/2015 | Gallagher et al. | |
| 8,999,935 B2 | 4/2015 | Huang | |
| 9,169,292 B2 | 10/2015 | Gallagher et al. | |
| 9,273,093 B2 | 3/2016 | Bhandari et al. | |
| 9,518,091 B2 | 12/2016 | Bhandari et al. | |
| 2003/0166514 A1 | 9/2003 | Jones et al. | |
| 2004/0176293 A1 | 9/2004 | Peterson et al. | |
| 2006/0183884 A1 | 8/2006 | Blaschuk et al. | |
| 2007/0032417 A1 | 2/2007 | Baell | |
| 2007/0166308 A1 | 7/2007 | Pullen et al. | |
| 2007/0197430 A1 | 8/2007 | Baell et al. | |
| 2008/0260820 A1 | 10/2008 | Borrelly et al. | |
| 2008/0300180 A1 | 12/2008 | Schambye et al. | |
| 2009/0053819 A1 | 2/2009 | Seymour et al. | |
| 2009/0257952 A1 | 10/2009 | Cochran et al. | |
| 2010/0190710 A1 | 7/2010 | Chemtob et al. | |
| 2010/0196441 A1 | 8/2010 | Sondermeijer et al. | |
| 2010/0272731 A1 | 10/2010 | Presta et al. | |
| 2010/0280098 A1 | 11/2010 | Juliano et al. | |
| 2011/0059087 A1 | 3/2011 | Lewis et al. | |
| 2011/0086024 A1 | 4/2011 | Arthos et al. | |
| 2011/0282029 A1 | 11/2011 | Holmes et al. | |
| 2012/0071422 A1 | 3/2012 | Gallagher et al. | |
| 2013/0029907 A1* | 1/2013 | Gallagher .............. | C07K 14/54 514/7.6 |
| 2013/0172272 A1 | 7/2013 | Gallagher et al. | |
| 2013/0183755 A1 | 7/2013 | Gallagher et al. | |
| 2013/0310303 A1 | 11/2013 | Eldar-Finkelman et al. | |
| 2014/0193465 A1 | 7/2014 | Bhandari et al. | |
| 2014/0294901 A1 | 10/2014 | Bhandari et al. | |
| 2014/0294902 A1 | 10/2014 | Bhandari et al. | |

(Continued)

FOREIGN PATENT DOCUMENTS

| | | |
|---|---|---|
| DE | 10107707 A1 | 8/2002 |
| WO | WO 97/25351 A2 | 7/1997 |

(Continued)

OTHER PUBLICATIONS

U.S. Appl. No. 15/000,923, filed Jan. 19, 2016, Bhandari et al.
Methods in Molecular Biology, vol. 35 Peptide Synthesis Protocols, Edited by M.W Pennington and B. M. Dunn Copyright, 1994 Humana Press Inc, Totowa, NJ, pp. 201-241.
Xie, Youmei et al., "Nerve Growth Factor (NGF) Loop 4 Dimeric Mimetics Activate ERK and AKT and Promote NGF-like Neurotrophic Effects", The Journal of Biological Chemistry, 275(38): 29868-29874 (2000).
U.S. Appl. No. 14/229,799, Office Action dated Mar. 4, 2016.
U.S. Appl. No. 14/229,784, Office Action dated Mar. 8, 2016.
European Application No. 13845982.1, Extended European Search Report dared May 13, 2016.

(Continued)

*Primary Examiner* — Julie Ha
(74) *Attorney, Agent, or Firm* — Cooley LLP

(57) ABSTRACT

Peptide inhibitors of the interleukin-23 receptor, and related compositions and methods of using these peptide inhibitors to treat or prevent a variety of diseases and disorders, including inflammatory bowel disease are described.

24 Claims, 11 Drawing Sheets

(56) References Cited

U.S. PATENT DOCUMENTS

| | | |
|---|---|---|
| 2014/0336110 A1 | 11/2014 | Ganz et al. |
| 2015/0056301 A1 | 2/2015 | Kawabe et al. |
| 2015/0157692 A1 | 6/2015 | Fu |
| 2016/0031944 A1 | 2/2016 | Bhandari et al. |
| 2016/0152664 A1 | 6/2016 | Bhandari et al. |
| 2016/0159862 A1 | 6/2016 | Bhandari et al. |

FOREIGN PATENT DOCUMENTS

| | | |
|---|---|---|
| WO | WO 99/26615 A1 | 6/1999 |
| WO | WO 00/18789 A1 | 4/2000 |
| WO | WO 00/18790 A1 | 4/2000 |
| WO | WO 00/23474 A1 | 4/2000 |
| WO | WO 00/61580 A1 | 10/2000 |
| WO | WO 01/68586 A2 | 9/2001 |
| WO | WO 03/066678 A1 | 8/2003 |
| WO | WO 2008/097461 A2 | 8/2008 |
| WO | WO 2008/134659 A2 | 11/2008 |
| WO | WO 2008/140602 A2 | 11/2008 |
| WO | WO 2009/002947 A2 | 12/2008 |
| WO | WO 2009/027752 A2 | 3/2009 |
| WO | WO 2011/149942 A2 | 12/2011 |
| WO | WO 2014/059213 A1 | 4/2014 |
| WO | WO 2014/127316 A2 | 8/2014 |
| WO | WO 2014/145561 A2 | 9/2014 |
| WO | WO 2014/165448 A1 | 10/2014 |
| WO | WO 2014/165449 A1 | 10/2014 |
| WO | WO 2015/176035 A1 | 11/2015 |
| WO | WO 2015/200916 A2 | 12/2015 |
| WO | WO 2016/011208 A1 | 1/2016 |
| WO | WO 2016/054411 A1 | 4/2016 |
| WO | WO 2016/054445 A1 | 4/2016 |

OTHER PUBLICATIONS

Gee et al. "Cyclic Peptides as Non-carboxyl-terminal Ligands of Syntrophin PDZ Domains," The Journal of Biological Chemistry, 273(34):21980-21987 (1998).

Jackson, D.Y., "Alpha 4 integrin antagonists." Current Pharmaceutical Design, (8)14: 1229-1253 (2002).

PCT/US2015/053558, International Search Report and Written Opinion, mailed Feb. 19, 2016.

U.S. Appl. No. 14/714,198, filed May 15, 2015, Bhandari et al.

U.S. Appl. No. 14/775,469, filed Mar. 17, 2014, Smythe et al.

U.S. Appl. No. 14/872,975, filed Oct. 1, 2015, Bhandari et al.

Chatterjee, J. et al., "N-Methylation of Peptides: a New Perspective in Medicinal Chemistry", Accounts of Chemical Research, 41(10): 1331-1342 (2008).

Definition of Isostere, Medical Definition and More from Merriam-Webster Dictionary, 3 pages, www.merriam-webster.com/medical/isostere accessed on Feb. 5, 2015.

Dubree, Nathan J.P. et al., "Selective a4B7 Integrin Antagonists and Their Potential as Antiinflammatory Agents", J. Med. Chem., 45: 3451-3457 (2002).

Dutta, Anand S., "Potent Cyclic Monomeric and Dimeric Peptide Inhibitors of VLA-4 (a4b1 Integrin)-Mediated Cell Adhesion Based on the Ile-Leu-Asp-Val Tetrapeptide", J. Peptide Sci., 6:321-341 (2000).

Haanstra, et al., "Antagonizing the a4B1 Integrin, but no a4B7, Inhibits Leukocytic Infiltration of the Central Nervous System in Rhesus Monkey Experimental Autoimmune Encephalomyelitis", Journal of Immunology, 90(5): 1961-1973 (2013).

Janssen et al., "Comparison of a Monomeric and Dimeric Radiolabeled RGD-Peptide for Tumor Targeting", Cancer Biotherapy and Radiopharmaceuticals, 17(6): 641-646 (2002).

Kelleman, A. et al., "Incorporation of thioether building blocks into an $\alpha_v\beta_3$-specific RGD peptide: Synthesis and biological activity", Biopolymers (Peptide Science), 71(6): 686-695 (2003).

Kluskens, L.D. et al., "Angiotensin-(1-7) with Thioether Bridge: An Angiotensin-Converting Enzyme-Resistant, Potent Angiotensin-(1-7) Analog", The Journal of Pharmacology and Experimental Therapeutics, 328(3): 849-855 (2009).

Liu, Shuang, "Radiolabeled Multimeric Cyclic RGD Peptides as Integrin avB3 Targeted Radiotracers for Tumor Imaging", School of Health Science, Purdue University, Molecular Pharmaceuticals, 3(5): 472-487 (2006).

PCT/US2013/064439, International Search Report and Written Opinion, mailed Jan. 24, 2014.

PCT/US2013/064439, International Preliminary Report on Patentability, dated Apr. 14, 2015.

PCT/US2014/030352, International Search Report and Written Opinion, mailed Nov. 28, 2014.

PCT/US2014/030352, International Preliminary Report on Patentability, dated Sep. 15, 2015.

PCT/US2014/032391, International Search Report, mailed Aug. 7, 2014.

PCT/US2014/032391, Written Opinion, mailed Aug. 7, 2014.

PCT/US2014/032391, International Preliminary Report on Patentability, dated Oct. 6, 2015.

PCT/US2014/032392, International Search Report and Written Opinion, mailed Sep. 15, 2014.

PCT/US2014/032392, International Preliminary Report on Patentability, dated Oct. 6, 2015.

PCT/US2015/031243, International Search Report and Written Opinion, mailed Aug. 5, 2015.

PCT/US2015/038370, International Search Report and Written Opinion, mailed Sep. 14, 2015.

PCT/US2015/040658, International Search Report and Written Opinion, mailed Oct. 28, 2015.

Soler-Ferran and Briskin, "Integrin $\alpha_4\beta_7$ Antagonists: Activities, Mechanisms of Action and Therapeutic Prospects", Current Immunology Reviews, 8(2): 118-134 (2012).

Temming, K. et al. "Rational Design of RGD-Albumin Conjugates for targeted Delivery of the VEGF-R Kinase Inhibitor PTK787 to Angiogenic Endothelium", ChemMedChem, 1: pp. 1200-1203 (2006).

Thermo Electron Corporation, Technical Information, "N-terminal and C-terminal Amidation of Peptides", 2 pages (2004).

Thumshirn, G. et al., "Multimeric Cyclic RGD Peptides as Potential Tools for Tumor Targeting: Solid Phase Peptide Synthesis and Chemoselective Oxime Ligation", Chem. Eur. J., 9: 2717-2725 (2003).

Waitemata District Health Board, "Crushing Guide for Oral Medication in Residential Aged Care", 2 pages (2011).

Yu and Gallagher, "A Naturally Occurring, Soluble Antagonist of Human IL-23 Inhibits the Development and In Vitro Function of Human Th17 Cells", The Journal of Immunology, 185: 7302-7308 (2010).

U.S. Appl. No. 14/050,349, Non-Final Office Action dated Feb. 27, 2015.

U.S. Appl. No. 14/229,784, Non-Final Office Action dated Aug. 13, 2015.

U.S. Appl. No. 14/229,799, Non-Final Office Action dated Jul. 24, 2015.

U.S. Appl. No. 14/050,349, Final Office Action dated Sep. 9, 2015.

U.S. Appl. No. 15/046,325, filed Feb. 17, 2016, Bhandari et al.

PCT/US2015/053603, International Search Report and Written Opinion, mailed Feb. 12, 2016.

Pelton, J.T. et al., "Somatostatin Analogs with Affinity for Opiate Receptors in Rat Brain Binding Assay", Peptides, 6(Suppl 1): 159-163 (1985).

U.S. App. No. 14/050,349, Notice of Allowance dated Jan. 12, 2016.

U.S. Appl. No. 15/255,750, filed Sep. 2, 2016, Bhandari et al.

U.S. Appl. No. 15/258,540, filed Sep. 7, 2016, Bhandari et al.

Clark, Richard J., et al. "Design, synthesis, and characterization of cyclic analogues of the iron regulatory peptide hormone hepcidin." Peptide Science (2013); 100.5: 519-526.

Database EPO Proteins [Online] Dec. 3, 2010 (Dec. 3, 2010), "Sequence from Patent WO2010124874." XP002761649, retrieved from EBI accession No. EPOP:HI656765 Database accession No. HI656765, 1 page.

Database USPTO Proteins [Online] Dec. 17, 2012 (Dec. 17, 2012), "Sequence from patent US 8313950.", XP002761650, retrieved from EBI accession No. USPOP:AGA36544 Database accession No. AGA36544, 1 page.

(56) References Cited

OTHER PUBLICATIONS

Desbenoit, N., et al. "Reversible metalation of a bis-disulfide analogue of the Cys*-X-Cys* hepcidin binding site: structural characterisation of the related copper complex]." Annales Pharmaceutiques Francaises (2010); 68(6): 388-396. (with English summary).
Dolain, Christel, et al. "Inducing α-Helices in Short Oligopeptides through Binding by an Artificial Hydrophobic Cavity." Journal of the American Chemical Society (2010); 132.16: 5564-5565.
European Application No. 14763104.8, Extended European Search Report dated Sep. 23, 2016, 10 pages.
European Application No. 14779463.0, Extended European Search Report mailed Nov. 19, 2016, 9 pages.
European Application No. 14780207.8, Partial Supplementary European Search Report mailed Nov. 16, 2016, 6 pages.
Kitazume and Yamazaki, Experimental Methods in Organic Fluorine Chemistry, Gordon and Breach Science Publishers, 1998, p. 9, 3 pages.
SID 24885660, National Center for Biotechnology Information, PubChem Substance Database; SID=24885660, 5 pages. https://pubchem.ncbi.nlm.nih.gov/substance/24885660, available date: Jul. 16, 2007, accessed Jul. 21, 2016.
U.S. Appl. No. 15/046,325, Office Action mailed Aug. 1, 2016, 13 pages.
U.S. Appl. No. 14/714,198, Office Action mailed Nov. 7, 2016, 6 pages.
U.S. Appl. No. 15/321,124, filed Dec. 21, 2016, Bourne et al.
Ley, Klaus, et al. "Integrin-based therapeutics: biological basis, clinical use and new drugs." Nature Reviews Drug Discovery (2016); 15.3: 173-183.
PCT/US2015/038370, International Preliminary Report on Patentability, mailed Dec. 27, 2016, 4 pages.
PCT/US2015/031243, International Preliminary Report on Patentability, mailed Nov. 22, 2016, 8 pages.
PCT/US2015/040658, International Preliminary Report on Patentability, mailed Jan. 17, 2017, 5 pages.
PCT/US2016/042680, International Search Report and Written Opinion, mailed Jan. 13, 2017, 12 pages.
Shahidi, Neal, et al. "Vedolizumab for the treatment of ulcerative colitis." Expert Opinion on Biological Therapy (2016); 16.1 : 129-135.
U.S. Appl. No. 14/872,975, Office Action mailed Dec. 27, 2016, 14 pages.

* cited by examiner

| 0 | Normal |
| --- | --- |
| 1 | Erythema |
| 2 | Erythema, slight edema, small erosions |
| 3 | Two or more bleeding ulcers, inflammation, moderate adhesions |
| 4 | Severe ulceration, stenosis with dilations, severe adhesions |

FIG. 5

| Group ID | Female SD Rat ID | TNBS at Day 0 | Test Article | | | | | | | | API in Drinking Water (mg/mL) | Termination at Day 6 |
|---|---|---|---|---|---|---|---|---|---|---|---|---|
| | | | ID | Formulation | Route | Dose (mg/Kg) | Con. (mg/mL) | Dose Vol. (mL/kg) | Frequency | | | |
| Group-1 | 1-8 | Sham, | None | PBS | PO | NA | NA | 5 | TID, Day -1 to Day 6 | | None | 1 hr post morning dose |
| Group-2 | 11-20 | 60 mg/kg | None | PBS | PO | NA | NA | 5 | TID, Day -1 to Day 6 | | None | 1 hr post morning dose |
| Group-3 | 21-30 | 60 mg/kg | Mouse anti-IL-23p19 | PBS | IP | 4 | 2 | 2 | Day -1 and Day 3, AND PBS PO TID at 5mL/kg | | | |
| Group-4 | 31-40 | 60 mg/kg | Compound C | PBS | PO | 20 | 4 | 5 | TID, Day -1 to Day 6 | | 0.6 | 1 hr post morning dose |
| Group-5 | 41-50 | 60 mg/kg | Compound C | PBS | PO | 6.7 | 1.3 | 5 | TID, Day -1 to Day 6 | | 0.2 | 1 hr post morning dose |

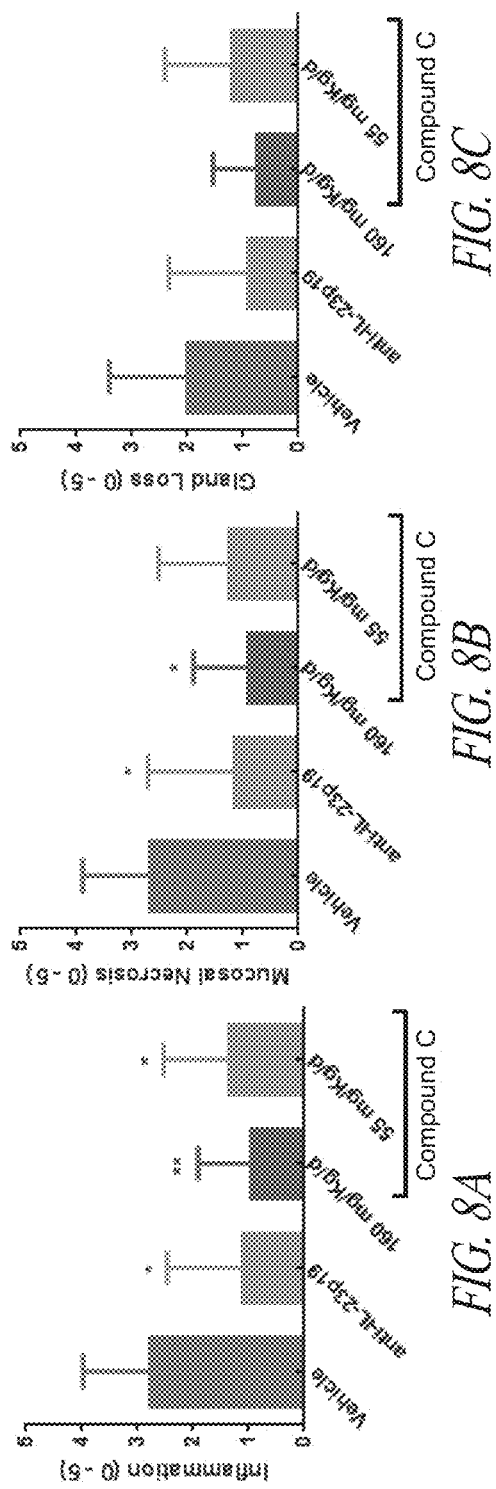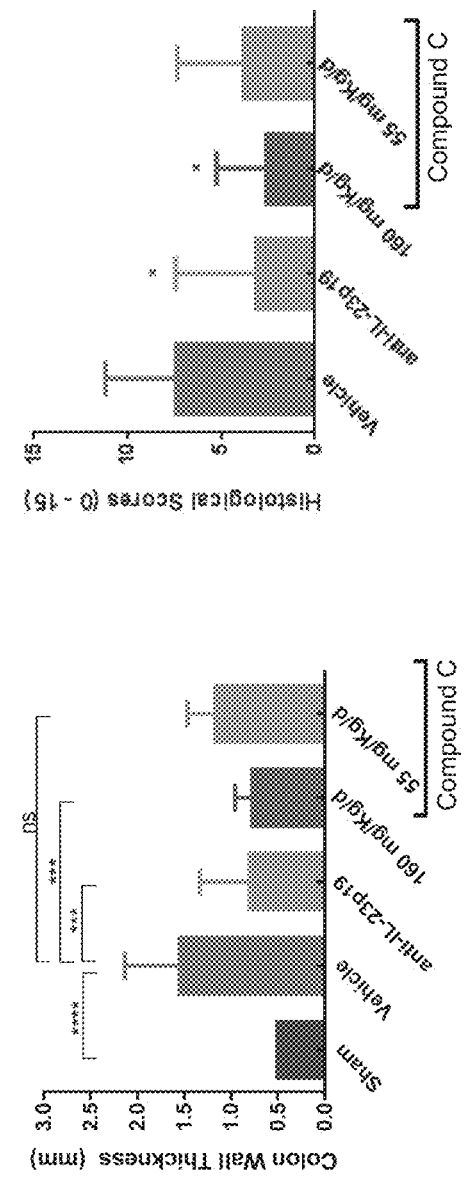

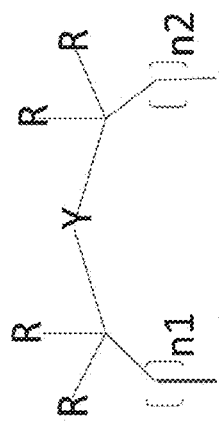
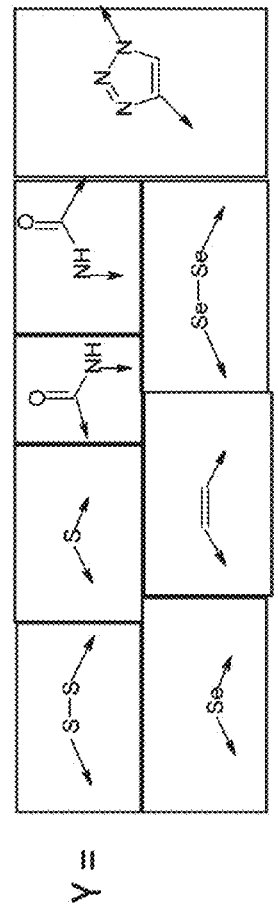
X1-X2-X3-X4-X5-X6-X7-X8-X9-X10-X11-X12-X13-X14-X15-X16-X17-X18-X19-X20
R = H, CH3
n1 = 0-6
n2 = 0-6
Y =
X4 = Any amino acid capable of forming bond with X9 with chemistries shown for Y
X9 = Any amino acid capable of forming bond with X9 with chemistries shown for Y
*FIG. 10*

ORAL PEPTIDE INHIBITORS OF INTERLEUKIN-23 RECEPTOR AND THEIR USE TO TREAT INFLAMMATORY BOWEL DISEASES

CROSS REFERENCE TO RELATED APPLICATIONS

This application claims priority to U.S. Provisional Application No. 62/025,899, filed on Jul. 17, 2014, U.S. Provisional Application No. 62/119,685, filed on Feb. 23, 2015, and U.S. Provisional Application No. 62/119,688, filed on Feb. 23, 2015, each of which is incorporated by reference herein in its entirety.

SEQUENCE LISTING

The instant application contains a Sequence Listing which has been submitted electronically in ASCII format and is hereby incorporated by reference in its entirety. Said ASCII copy, created on Oct. 8, 2015, is named PRTH-002-02US_SL.txt and is 516,536 bytes in size.

FIELD OF THE INVENTION

The present invention relates to novel peptide inhibitors of the interleukin-23 receptor, and their use to treat or prevent a variety of diseases and disorders, including inflammatory bowel disease, Crohn's disease and psoriasis.

BACKGROUND

The interleukin-23 (IL-23) cytokine has been implicated as playing a crucial role in the pathogenesis of autoimmune inflammation and related diseases and disorders, such as multiple sclerosis, asthma, rheumatoid arthritis, psoriasis, and inflammatory bowel diseases (IBDs), e.g., ulcerative colitis and Crohn's disease. Studies in acute and chronic mouse models of IBD revealed a primary role of IL-23R and downstream effector cytokines in disease pathogenesis. IL-23R is expressed on various adaptive and innate immune cells including Th17 cells, γδ T cells, natural killer (NK) cells, dendritic cells, macrophages, and innate lymphoid cells, which are found abundantly in the intestine. At the intestine mucosal surface, the gene expression and protein levels of IL-23R are found to be elevated in IBD patients. It is believed that IL-23 mediates this effect by promoting the development of a pathogenic CD4$^+$ T cell population that produces IL-6, IL-17, and tumor necrosis factor (TNF).

Production of IL-23 is enriched in the intestine, where it is believed to play a key role in regulating the balance between tolerance and immunity through T-cell-dependent and T-cell-independent pathways of intestinal inflammation through effects on T-helper 1 (Th1) and Th17-associated cytokines, as well as restraining regulatory T-cell responses in the gut, favoring inflammation. In addition, polymorphisms in the IL-23 receptor (IL-23R) have been associated with susceptibility to IBDs, further establishing the critical role of the IL-23 pathway in intestinal homeostasis.

Psoriasis, a chronic skin disease affecting about 2%-3% of the general population has been shown to be mediated by the body's T cell inflammatory response mechanisms. IL-23 has one of several interleukins implicated as a key player in the pathogenesis of psoriasis, purportedly by maintaining chronic autoimmune inflammation via the induction of interleukin-17, regulation of T memory cells, and activation of macrophages. Expression of IL-23 and IL-23R has been shown to be increased in tissues of patients with psoriasis, and antibodies that neutralize IL-23 showed IL-23-dependent inhibition of psoriasis development in animal models of psoriasis.

IL-23 is a heterodimer composed of a unique p19 subunit and the p40 subunit of IL-12, which is a cytokine involved in the development of interferon-γ (IFN-γ)-producing T helper 1 (T$_H$1) cells. Although IL-23 and IL-12 both contain the p40 subunit, they have different phenotypic properties. For example, animals deficient in IL-12 are susceptible to inflammatory autoimmune diseases, whereas IL-23 deficient animals are resistant, presumably due to a reduced number of CD4$^+$ T cells producing IL-6, IL-17, and TNF in the CNS of IL-23-deficient animals. IL-23 binds to IL-23R, which is a heterodimeric receptor composed of IL-12Rβ1 and IL-23R subunits. Binding of IL-23 to IL-23R activates the Jak-stat signaling molecules, Jak2, Tyk2, and Stat1, Stat 3, Stat 4, and Stat 5, although Stat4 activation is substantially weaker and different DNA-binding Stat complexes form in response to IL-23 as compared with IL-12. IL-23R associates constitutively with Jak2 and in a ligand-dependent manner with Stat3. In contrast to IL-12, which acts mainly on naive CD4(+) T cells, IL-23 preferentially acts on memory CD4(+) T cells.

Efforts have been made to identify therapeutic moieties that inhibit the IL-23 pathway, for use in treating IL-23-related diseases and disorders. A number of antibodies that bind to IL-23 or IL-23R have been identified, including ustekinumab, a humanized antibody that binds IL-23, which has been approved for the treatment of psoriasis. More recently, polypeptide inhibitors that bind to IL-23R and inhibit the binding of IL-23 to IL-23R have been identified (see, e.g., US Patent Application Publication No. US2013/0029907). Clinical trials in Crohn's Disease or psoriasis with ustekinumab and briakinumab (which target the common p40 subunit) and tildrakizumab, guselkumab, MEDI2070, and BI-655066 (which target the unique p19 subunit of IL-23) highlight the potential of IL-23 signaling blockade in treatment of human inflammatory diseases. While these findings are promising, challenges remain with respect to identifying stable and selective agents that preferentially target the IL-23 pathway in the intestine, which can be used for the treatment of intestinal inflammation, such as intestinal bowel diseases, including Crohn's disease, ulcerative colitis and related disorders.

Clearly, there remains a need in the art for new therapeutics targeting the IL-23 pathway, which may be used to treat and prevent IL-23-associated diseases, including those associated with autoimmune inflammation in the intestinal tract. In addition, compounds and methods for specific targeting of IL-23R from the luminal side of the gut may provide therapeutic benefit to IBD patients suffering from local inflammation of the intestinal tissue. The present invention addresses these needs by providing novel peptide inhibitors that bind IL-23R to inhibit IL-23 binding and signaling and which are suitable for oral administration.

BRIEF SUMMARY OF THE INVENTION

The present invention provides inter alia novel peptide inhibitors of IL-23R and related methods of use.

In a first aspect, the present invention provides a peptide inhibitor of an interleukin-23 receptor, or a pharmaceutically acceptable salt or solvate thereof, wherein the peptide inhibitor comprises an amino acid sequence of Formula (Xa):

$$X1\text{-}X2\text{-}X3\text{-}X4\text{-}X5\text{-}X6\text{-}X7\text{-}X8\text{-}X9\text{-}X10\text{-}X11\text{-}X12\text{-}X13\text{-}X14\text{-}X15\text{-}X16\text{-}X17\text{-}X18\text{-}X19\text{-}X20 \quad (Xa),$$

wherein:

X1, X2 and X3 are any amino acid or absent
X4 is any amino acid or chemical moiety capable of forming a bond with X9;
X5, X6, X7 and X8 are any amino acid;
X9 is any amino acid or chemical moiety capable of forming a bond with X4;
X10, X11, X12, X13, X14 and X15 are any amino acid; and
X16, X17, X18, X19 and X20 are any amino acid or absent;
   wherein the peptide inhibitor is cyclized via a bond between X4 and X9, and
   wherein the peptide inhibitor inhibits the binding of an interleukin-23 (IL-23) to an IL-23 receptor.

In certain embodiments of Xa:
X1 is absent; X2 is absent; X3 is absent; X4 is Cys, Abu or Pen; X5 is Ala, α-MeOrn, α-MeSer, Cit, Dap, Dab, Dap(Ac), Gly, Lys, Asn, N-MeGln, N-MeArg, Orn, Gln, Arg, Ser or Thr; X6 is Asp or Thr; X7 is Trp or 6-Chloro-Trp; X8 is Glu, Gln or Val; X9 is Cys, Abu or Pen; X10 is 2-Nal, a Phe analog, Tyr, or a Tyr analog; X11 is 1-Nal, 2-Nal, Phe(3,4-dimethoxy), 5-HydroxyTrp, Phe(3,4-Cl$_2$), Trp or Tyr(3-tBu); X12 is 3-Pal, Acpc, Acbc, Acvc, Achc, Agp, Aib, α-DiethylGly, α-MeLys, α-MeLys(Ac), α-MeLeu, α-MeOrn, α-MeSer, α-MeVal, Cav, Cha, Cit, Cpa, D-Asn, Glu, His, hLeu, hArg, Lys, Leu, Octgly, Orn, 4-amino-4-carboxy-piperidine, Arg, Ser, Thr or THP; X13 is Cit, Asp, Dab, Dap, Phe, His, Dap(Peg2-Ac), Dap(pyroglutaric acid), Glu, HomoArg, Lys, Lys(Ac), Lys(Benzoic acid), Lys(glutaric acid), Lys(IVA), Lys(Peg4-isoGlu-Palm), Lys(pyroglutaric acid), Lys(succinic acid), Asn, Orn, Gln, Arg, Thr or Val; X14 is Asp, Dab(Ac), Dap(Ac), Phe, His, Lys(Ac), Met, Asn(isobutyl), Gln, Arg, Tyr or Asp(1,4-diaminobutane); and X15 is Ala, βAla, Glu, Gly, Asn, Gln, Arg or Ser.

In certain embodiments of Xa: X1 is absent; X2 is absent; X3 is absent; X4 is Cys, Abu or Pen; X5 is Ala, α-MeOrn, α-MeSer, Cit, Dap, Dab, Dap(Ac), Gly, Lys, Asn, Orn, Gln, Arg, Ser or Thr; X6 is Asp or Thr; X7 is Trp or 6-Chloro-Trp; X8 is Gln or Val; X9 is Cys, Abu or Pen; X10 is 2-Nal, a Phe analog, Tyr, or a Tyr analog; X11 is 1-Nal, 2-Nal, Phe(3,4-dimethoxy), 5-HydroxyTrp, Phe(3,4-Cl$_2$), Trp or Tyr(3-tBu); X12 is 3-Pal, Acpc, Acbc, Acvc, Achc, Agp, Aib, α-DiethylGly, α-MeLys, α-MeLys(Ac), α-MeLeu, α-MeOrn, α-MeSer, α-MeVal, Cav, Cha, Cit, Cpa, D-Asn, His, hLeu, hArg, Lys, Leu, Octgly, Orn, 4-amino-4-carboxy-piperidine, or THP; X13 is Cit, Asp, Dab, Dap, Phe, His, Dap(Peg2-Ac), Dap(pyroglutaric acid), Glu, hArg, Lys, Lys(Ac), Lys(Benzoic acid), Lys(glutaric acid), Lys(IVA), Lys(Peg4-isoGlu-Palm), Lys(pyroglutaric acid), Lys-(succinic acid), Asn, Orn, Gln, Arg, Thr or Val; X14 is Dab(Ac), Dap(Ac), Phe, His, Lys(Ac), Met, Asn, Gln, Arg, or Tyr; and X15 is Ala, betaAla, Gly, Asn, Gln, or Ser.

In certain embodiments of Xa: X1 is absent; X2 is absent; X3 is absent; X4 is Cys, Abu or Pen; X5 is Dap, Dap(Ac), Gly, Lys, Gln, Arg, Ser, Thr or Asn; X6 is Thr; X7 is Trp or 6-Chloro-Trp; X8 is Gln; X9 is Cys, Abu or Pen; X10 is 2-Nal, a Phe analog, Tyr, or a Tyr analog; X11 is 1-Nal, 2-Nal, Phe(3,4-dimethoxy), Phe(3,4-Cl$_2$), or Trp; X12 is Acpc, Acbc, Acvc, Achc, Aib, α-DiethylGly, α-MeLys, α-MeLys(Ac), α-MeLeu, α-MeOrn, α-MeSer, α-MeVal, Cha, Cit, hLeu, Lys, Leu, Arg or THP; X13 is Cit, Asp, Dap, Dap(Peg2-Ac), Dap(pyroglutaric acid), Glu, hArg, Lys, Lys(Ac), Lys(Benzoic acid), Lys(glutaric acid), Lys(IVA), Lys(Peg4-isoGlu-Palm), Lys(pyroglutaric acid), Lys-(succinic acid), Asn, Orn, Gln, Arg, or Val; X14 is Dab(Ac), Dap(Ac), His, Lys(Ac), Asn, Gln, or Tyr; and X15 is Ala, betaAla, Gly, Asn, Gln, or Ser.

In certain embodiments of Xa: X1 is absent; X2 is absent; X3 is absent; X4 is Cys, Abu or Pen; X5 is Dap, Dap(Ac), Gln, Ser, Thr or Asn; X6 is Thr; X7 is Trp; X8 is Gln; X9 is Cys, Abu or Pen; X10 is a Phe analog, Tyr, or a Tyr analog; X11 is 2-Nal or Trp; X12 is Acpc, Acbc, Acvc, Achc, Aib, α-DiethylGly, α-MeLys, α-MeLys(Ac), α-MeLeu, α-MeOrn, α-MeSer, α-MeVal, hLeu, Leu, or THP; X13 is Cit, Asp, Glu, Lys, Lys(Ac), Asn, or Gln; X14 is Dab(Ac), Asn, or His; and X15 is Ala, betaAla, Gly, Asn, or Gln.

In certain embodiments of Xa: X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys, Sec, 2-chloromethylbenzoic acid, mercapto-propanoic acid, mercapto-butyric acid, 2-chloro-acetic acid, 3-chloropropanoic acid, 4-chlorobutyric acid, 3-chloroisobutyric acid, Abu, β-azido-Ala-OH, propargylglycine, 2-(3'-butenyl)glycine, 2-allylglycine, 2-(3'-butenyl)glycine, 2-(4'-pentenyl)glycine, 2-(5'-hexenyl)glycine, or Abu; X7 is Trp, Glu, Gly, Ile, Asn, Pro, Arg, Thr or OctGly, or a corresponding α-methyl amino acid form of any of the foregoing; X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, or Ser, Sec, Abu, β-azido-Ala-OH, propargylglycine, 2-2-allylglycine, 2-(3'-butenyl)glycine, 2-(4'-pentenyl)glycine, Ala, hCys, Abu, Met, MeCys, (D)Tyr or 2-(5'-hexenyl)glycine; X10 is Tyr, Phe (4-OMe), 1-Nal, 2-Nal, Aic, α-MePhe, Bip, (D)Cys, Cha, DMT, (D)Tyr, Glu, His, hPhe(3,4-dimethoxy), hTyr, N-MeTyr, Trp, Phe(4-CONH$_2$), Phe(4-phenoxy), Thr, Tic, Tyr(3-tBu), Phe(4-tBu), Phe(4-CN), Phe(4-Br), Phe(4-NH$_2$), Phe(4-F), Phe(3,5-F$_2$), Phe(4-CH$_2$CO$_2$H), Phe(penta-F), Phe(3,4-Cl$_2$), Phe(4-CF$_3$), Phe(4-OCH$_3$), Bip, Cha, 4-PyridylAlanine, βhTyr, OctGly, Phe(4-N$_3$), Phe(4-Br), Phe[4-(2-aminoethoxy)] or Phe, a Phe analog, a Tyr analog, or a corresponding α-methyl amino acid form of any of the foregoing; X11 is 2-Nal, 1-Nal, 2,4-dimethylPhe, Bip, Phe (3,4-Cl$_2$), Phe(3,4-F$_2$), Phe(4-CO$_2$H), βhPhe(4-F), α-MeTrp, 4-phenylcyclohexyl, Phe(4-CF$_3$), α-MePhe, βhNal, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino, Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe(4-CONH$_2$), Phe(3,4-Dimethoxy), Phe(2,3-Cl$_2$), Phe(2,3-F$_2$), Phe(4-F), 4-phenylcyclohexylalanine, Bip, or a corresponding α-methyl amino acid form of any of the foregoing; X12 is His, Phe, Arg, N-Me-His, Val, Cav, Cpa, Leu, Cit, hLeu, 3-Pal, t-butyl-Ala, 4-amino-4-carboxy-tetrahydropyran, Achc Acpc, Acvc, Acbc, Agp, Aib, α-DiethylGly, α-MeLys, α-MeLys(Ac), α-Me-Leu, α-MeOrn, α-MeSer, α-MeVal, Aib, D-Ala, (D)Asn, (D)Asp, (D)Leu, (D)Phe, (D)Tyr, Aib, α-MeLeu, α-MeOrn, β-Aib, β-Ala, βhAla, βhArg, βhLeu, βhVal, β-spiro-pip, Glu, hArg, Ile, Lys, N-MeLeu, N-MeArg, Ogl, Orn, Pro, Gln, Ser, Thr, Tle, t-butyl-Gly, or a corresponding α-methyl amino acid form of any of the foregoing; X13 is Thr, Sarc, Glu, Phe, Arg, Leu, Lys, Arg, Orn, Val, βhAla, Lys(Ac), (D)Asn, (D)Leu, (D)Phe, (D)Thr, Ala, α-MeLeu, Aib, β-Ala, β-Glu, βhLeu, βhVal, β-spiro-pip, Cha, Chg, Asp, Dab, Dap, α-DiethylGly, hLeu, Asn, Ogl, Pro, Gln, Ser, β-spiro-pip, Thr, Tba, Tle or Aib, Cit, hArg, Lys, Asn, Orn, Gln or a corresponding α-methyl amino acid form of any of the foregoing; X14 is Phe, Tyr, Glu, Gly, His, Lys, Leu, Met, Asn, Pro, Gln, Arg, Ser, Thr, TicβhPhe, Arg, Lys(Ac), His; Dap(Ac), Dab(Ac), Asp or a corresponding α-methyl amino acid form of any of the foregoing; X15 is Gly, Ser, Thr, Gln, Ala, (D)Ala, (D)Asn, (D)Asp, (D)Leu, (D)Phe, (D)Thr, Aea, Asp, Asn, Glu, Phe, Gly, Lys, Leu, Pro, Arg, β-Ala, Sarc, or a corresponding α-methyl amino acid form of any of the foregoing; X16 is Asp, Glu, Ala, AEA, AEP, βhAla, Gaba, Gly, Ser, Pro, Asn, Thr or absent, or a corresponding α-methyl amino acid form of any of the foregoing; and X17 is Leu, Lys, Arg, Glu, Ser, Gly, Gln or absent, or a corresponding α-methyl amino acid form of any of the foregoing.

In certain embodiments of peptide inhibitors of Xa, the bond is a disulfide bond, a thioether bond, a lactam bond, a triazole ring, a selenoether bond, a diselenide bond, or an olefin bond.

In particular embodiments of peptide inhibitors of Xa, X4 is Cys and X9 is Cys, and the bond is a disulfide bond. In particular embodiments, X4 is Pen and X9 is Pen, and the bond is a disulfide bond. In certain embodiments: X7 is Trp; X10 is Phe, Tyr, a Phe analog, or a Tyr analog; X11 is Trp, 1-Nal or 2-Nal; and X12 is Aib, α-Me-Lys, α-Me-Leu, Achc, Acvc, Acpc, Acbc or THP. In certain embodiments: X7 is Trp; X10 is Phe, Tyr, a Phe analog, or a Tyr analog; X11 is Trp, 1-Nal or 2-Nal; and X12 is Aib, α-Me-Lys or α-Me-Leu. In particular embodiments, the peptide inhibitor comprises any of the following the amino acid sequences: Pen-Q-T-W-Q-Pen-[Phe(4-OMe)]-[2-Nal]-[α-Me-Lys]-E-N-G (SEQ ID NO: 254); Pen-N-T-W-Q-[Pen]-[Phe[4-(2-aminoethoxy)]-[2-Nal]-[Aib]-[Lys(Ac)]-N—N (SEQ ID NO: 255); Pen-Q-T-W-Q-[Pen]-[Phe[4-(2-aminoethoxy)]-[2-Nal]-[α-MeLeu]-[Lys(Ac)]-N—N (SEQ ID NO: 256); or Pen-Q-T-W-Q-[Pen]-[Phe(4-CONH$_2$)]-[2-Nal]-[α-MeLys]-[Lys(Ac)]-N—N (SEQ ID NO: 257), wherein the peptide inhibitor comprises a disulfide bond between the two Pen amino acids.

In particular embodiments of peptide inhibitors of Xa, X4 is an amino acid, aliphatic acid, alicyclic acid or modified 2-methyl aromatic acid having a carbon side chain capable of forming a thioether bind with X9; X9 is a sulfur-containing amino acid capable of forming a thioether bond with X4, and the bond between X4 and X9 is a thioether bond. In certain embodiments, X4 is Abu, 2-chloromethyl-benzoic acid, mercapto-propanoic acid, mercapto-butyric acid, 2-chloro-acetic acid, 3-chloro-propanoic acid, 4-chloro-butyric acid, 3-chloro-isobutyric acid; and X9 is Abu, Cys, Pen, hCys, D-Pen, D-Cys, or D-hCys. In certain embodiments, X4 is Abu; and X9 is Cys. In certain embodiments; X7 is Trp; X10 is Phe, Tyr, a Phe analog, or a Tyr analog; X11 is Trp, 1-Nal or 2-Nal; and X12 is α-Me-Lys, α-Me-Leu, α-Me-Ser, α-Me-Val, Achc, Acvc, Acpc, Acbc, or [4-amino-4-carboxy-tetrahydropyran]. In certain embodiments, X7 is Trp; X10 is Phe, Tyr, a Phe analog, or a Tyr analog; X11 is Trp, 1-Nal or 2-Nal; and X12 is α-Me-Lys or [4-amino-4-carboxy-tetrahydropyran]. In particular embodiments, the peptide inhibitor comprises any of the following amino acid sequences: [Abu]-Q-T-W-Q-C-[Phe(4-OMe)]-[2-Nal]-[α-MeLys]-E-N-G (SEQ ID NO: 258); [Abu]-Q-T-W-Q-C-[Phe(4-(2-aminoethoxy))]-W-[α-MeLys]-E-N-G (SEQ ID NO: 259); or [Abu]-Q-T-W-Q-C-[Phe[4-(2-aminoethoxy)]]-[2-Nal]-[4-amino-4-carboxy-tetrahydropyran]-E-N—N (SEQ ID NO: 260), wherein the peptide inhibitor comprises a thioether bond between the Abu and the C.

In certain embodiments of peptide inhibitors of Xa: X4 is Pen, Cys or hCys; X5 is any amino acid; X6 is any amino acid; X7 is Trp, Bip, Gln, His, Glu(Bzl), 4-Phenylbenzyl-alanine, Tic, Phe[4-(2-aminoethoxy)], Phe(3,4-Cl$_2$), Phe(4-OMe), 5-Hydroxy-Trp, 6-Chloro-Trp, N-MeTrp, α-Me-Trp, 1,2,3,4-tetrahydro-norharman, Phe(4-CO$_2$H), Phe(4-CONH$_2$), Phe(3,4-Dimethoxy), Phe(4-CF$_3$), Phe(4-tBu), ββ-diPheAla, Glu, Gly, Ile, Asn, Pro, Arg, Thr or Octgly, or a corresponding α-methyl amino acid form of any of the foregoing; X8 is any amino acid; X9 is Pen, Cys or hCys; X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly, a Phe analog or a Tyr analog (optionally, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), or Phe(4-OBzl)), or a corresponding α-methyl amino acid form of any of the foregoing; X11 is 2-Nal, 1-Nal, 2,4-dimethylPhe, Bip, Phe(3,4-Cl$_2$), Phe(3,4-F$_2$), Phe(4-CO$_2$H), βhPhe(4-F), α-Me-Trp, 4-phenylcyclohexyl, Phe(4-CF$_3$), α-MePhe, βhNal, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino), Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe(4-CONH$_2$), Phe(3,4-OMe$_2$) Phe(2,3-Cl$_2$), Phe(2,3-F$_2$), Phe(4-F), 4-phenylcyclohexyl-alanine or Bip, or a corresponding α-methyl amino acid form of any of the foregoing; X12 is α-MeLys, α-MeOrn, α-MeLeu, α-MeVal, 4-amino-4-carboxy-tetrahydropyran, Achc, Acpc, Acbc, Acvc, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing; X13 is Lys(Ac), (D)Asn, (D)Leu, (D)Thr, (D)Phe, Ala, Aib, α-MeLeu, β-Ala, βhGlu, βhAla, βhLeu, βhVal, β-spiro-pip, Cha, Chg, Asp, Lys, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing; X14 is Asn, Glu, Phe, Gly, His, Lys, Leu, Met, Asn, Pro, Gln, Arg, Ser, Thr, Tic or Tyr, Lys(Ac), Orn or a corresponding α-methyl amino acid form of any of the foregoing; X15 is Gly, (D)Ala, (D)Asn, (D)Asp, Asn, (D)Leu, (D)Phe, (D)Thr, Ala, AEA, Asp, Glu, Phe, Gly, Lys, Leu, Pro, Gln, Arg or Ser, β-Ala, Arg or a corresponding α-methyl amino acid form of any of the foregoing; X16 is absent, Gly, Ala, Asp, Ser, Pro, Asn or Thr, or a corresponding α-methyl amino acid form of any of the foregoing; X17 is absent, Glu, Ser, Gly or Gln, or a corresponding α-methyl amino acid form of any of the foregoing; X18 is absent or any amino acid; X19 is absent or any amino acid; and X20 is absent or any amino acid. In particular embodiments, the bond between X4 and X9 is a disulfide bond. In certain embodiments, X1, X2, and X3 are absent. In certain embodiments, X17, X19 and X20 are absent. In certain embodiments, one or both of X4 or X9 is Pen. In certain embodiments, both X4 and X9 are Pen. In particular embodiments, X18 is (D)-Lys. In certain embodiments, the peptide inhibitors comprise one or more, two or more, three or more, or four of the following: X5 is Arg, Asn, Gln, Dap, Orn; X6 is Thr or Ser; X7 is Trp, 2-Nal, 1-Nal, Phe(4-OAllyl), Tyr(3-tBu), Phe(4-tBu), Phe(4-guanidino), Phe(Bzl) or Phe(4-Me), 5-Hydroxy-Trp, 6-Chloro-Trp, N-MeTrp, α-MeTrp or 1,2,3,4-tetrahydro-norharman; and X8 is Gln, Val, Phe, Glu, Lys. In certain embodiments, the peptide inhibitors comprise one or more, two or more, three or more, four or more, five or more, six or more, or seven of the following: X10 is Tyr, Phe(4-OBzl), Phe(4-OMe), Phe(4-CONH$_2$), Phe(3,4-Cl$_2$), Phe(4-tBu), Phe(4-NH$_2$), Phe(4-Br), Phe(4-CN), Phe(4-

$CO_2H$), Phe(4-(2aminoethoxy)) or Phe(4-guanadino); X11 is Trp, 2-Nal, 1-Nal, Phe(4-OAllyl), Tyr(3-tBu), Phe(4-tBu), Phe(4-guanidino), Phe(Bzl) or Phe(4-Me), 5-Hydroxy-Trp, 6-Chloro-Trp, N-MeTrp, α-MeTrp or 1,2,3,4-tetrahydro-norharman; X12 is Arg, α-MeLys α-MeLeu, Aib or α-MeOrn; X13 is Lys, Glu or Lys(Ac); X14 is Phe or Asn; X15 is Gly, Ser or Ala; and X16 is absent or AEA. In certain embodiments, X4 and X9 are Pen; X5 is Gln; X6 is Thr; X7 is Trp; X8 is Gln; X10 is Tyr, Phe(4-OMe) or 2-Nal; X11 is Trp, 2-Nal or 1-Nal; X12 is Arg, αMeLys or α-MeOrn; X13 is Lys, Glu or Lys(Ac); X14 is Phe or Asn; X15 is Gly; and X16 is absent. In certain embodiments, one or more of X1, X2 and X3 are absent; and one or more, two or more, three or more, or four of X17, X18, X19 and X20 are absent.

In certain embodiments of peptide inhibitors of Xa: X4 is Abu, Pen, or Cys; X7 is Trp, Bip, Gln, His, Glu(Bzl), 4-Phenylbenzylalanine, Tic, Phe[4-(2-aminoethoxy)], Phe (3,4-$Cl_2$), Phe(4-OMe), 5-Hydroxy-Trp, 6-Chloro-Trp, N-MeTrp, α-MeTrp, 1,2,3,4-tetrahydro-norharman, Phe(4-$CO_2H$), Phe(4-$CONH_2$), Phe(3,4-Dimethoxy), Phe(4-$CF_3$), ββ-diPheAla, Phe(4-tBu), Glu, Gly, Ile, Asn, Pro, Arg, Thr or Octgly, or a corresponding α-methyl amino acid form of any of the foregoing; X9 is Abu, Pen, or Cys; X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly a Phe analog or a Tyr analog, or a corresponding α-methyl amino acid form of any of the foregoing; X11 is 2-Nal, 1-Nal, 2,4-dimethylPhe, Bip, 4-phenylcyclohexyl, Glu(Bzl), 4-Phenylbenzylalanine, Tic, Phe[4-(2-aminoethoxy)], Phe(3,4-$Cl_2$), Phe(3,4-$F_2$), βhPhe (4-F), Phe(4-OMe), 5-Hydroxy-Trp, 6-Chloro-Trp, N-MeTrp, α-MeTrp, 1,2,3,4-tetrahydro-norharman, Phe(4-$CO_2H$), Phe(4-$CONH_2$), Phe(3,4-Dimethoxy), Phe(4-$CF_3$), Phe(2,3-$Cl_2$), Phe(2,3-$F_2$), Phe(4-F), 4-phenylcyclohexyl-alanine, α-MePhe, βhNal, βhPhe, βhTyr, βhTrp, Bip, Nva (5-phenyl), Phe, His, hPhe, Tqa, Trp, Tyr, Phe(4-Me), Trp (2,5,7-tri-tertButyl), Phe(4-OAllyl), Tyr(3-tBu), Phe(4-tBu), Phe(4-guanidino), Phe(4-OBzl), or Octgly, or a corresponding α-methyl amino acid form of any of the foregoing; X12 is α-MeLys, α-MeOrn, α-MeLeu, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing; X13 is Lys(Ac), (D)Asn, (D)Leu, (D)Thr, (D)Phe, Ala, Aib, α-MeLeu, βAla, βhGlu, βhAla, βhLeu, βhVal, β-spiro-pip, Cha, Chg, Asp, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing; X14 is Asn, Glu, Phe, Gly, His, Lys, Leu, Met, Asn, Pro, Gln, Arg, Ser, Thr, Tic or Tyr, or a corresponding α-methyl amino acid form of any of the foregoing; X15 is Gly, (D)Ala, (D)Asn, (D)Asp, Asn, (D)Leu, (D)Phe, (D)Thr, Ala, AEA, Asp, Glu, Phe, Gly, Lys, Leu, Pro, Gln, Arg or Ser, or a corresponding α-methyl amino acid form of any of the foregoing, or X15 is Gly, (D)Ala, (D)Asn, (D)Asp, Asn, (D)Leu, (D)Phe, (D)Thr, Ala, Asn, Ser, AEA, Asp, Glu, Phe, Gly, Lys, Leu, Pro, Gln, Arg or Ser, or a corresponding α-methyl amino acid form of any of the foregoing; X16 is absent, Gly, Ala, Asp, Ser, Pro, Asn or Thr, or a corresponding α-methyl amino acid form of any of the foregoing; and X17 is absent, Glu, Ser, Gly or Gln, or a corresponding α-methyl amino acid form of any of the foregoing. In particular embodiments, the peptide inhibitor is cyclized via an intramolecular bond between X4 and X9. In certain embodiments, one or more of X1, X2, and X3 are absent. In certain embodiments, one or more of X17, X19 and X20 are absent. In certain embodiments, one of X4 or X9 is Abu, and the other of X4 or X9 is not Abu. In certain embodiments, the peptide inhibitors comprise one or more, two or more, three or more, or four of the following: X5 is Arg, Gln, Dap or Orn; X6 is Thr or Ser; X7 is Trp, 2-Nal, 1-Nal, Phe(4-OAllyl), Tyr(3-tBu), Phe(4-tBu), Phe(4-guanidino), Phe(4-OBzl), Phe(4-Me), 5-Hydroxy-Trp, 6-Chloro-Trp, N-MeTrp, or α-MeTrp, 1,2,3,4-tetrahydro-norharman; and X8 is Gln, Val, Phe, Glu or Lys. In certain embodiments, the peptide inhibitors comprise one or more, two or more, three or more, four or more, five or more, six or more, or seven of the following: X10 is Tyr, Phe(4-OBzl), Phe(4-OMe), Phe (4-$CONH_2$), Phe(3,4-$Cl_2$), Phe(4-tBu), Phe(4-$NH_2$), Phe(4-Br), Phe(4-CN), Phe(4-$CO_2H$), Phe(4-(2aminoethoxy)) or Phe(4-guanadino); X11 is Trp, 2-Nal, 1-Nal, Phe(4-OAllyl), Tyr(3-tBu), Phe(4-tBu), Phe(4-guanidino), Phe(Bzl) or Phe (4-Me), 5-Hydroxy-Trp, 6-Chloro-Trp, N-MeTrp, α-MeTrp or 1,2,3,4-tetrahydro-norharman; X12 is Arg, hLeu, (D)Asn, Aib, α-MeLys, α-MeLeu or α-MeOrn; X13 is Lys, Glu or Lys(Ac); X14 is Phe or Asn; X15 is Gly, Ser or Ala, or X15 is Asn, Gly, Ser, βAla or Ala; and X16 is absent or AEA.

In another aspect, the present invention includes peptide inhibitors comprising the structure of Formula I:

$$R^1-X-R^2 \qquad (I)$$

or a pharmaceutically acceptable salt or solvate thereof, wherein $R^1$ is a bond, hydrogen, a C1-C6 alkyl, a C6-C12 aryl, a C6-C12 aryl, a C1-C6 alkyl, a C1-C20 alkanoyl, and including PEGylated versions alone or as spacers of any of the foregoing;

$R^2$ is a bond, OH or $NH_2$; and

X is any of the peptide sequences described herein, e.g., Xa, Ia, Ib, Ic, Id, Ie.

In a related aspect, the present invention includes a peptide dimer inhibitor of an interleukin-23 receptor, wherein the peptide dimer inhibitor comprises two peptide monomer subunits connected via one or more linker moieties, wherein each peptide monomer subunit has a sequence or structure set forth herein. In certain embodiments, one or both peptide monomer subunit is cyclized via an intramolecular bond between X4 and X9. In certain embodiments, one or both intramolecular bond is a disulfide bond, a thioether bond, a lactam bond, a selenoether, diselenide, or an olefin bond. In certain embodiments, the linker is any of those shown in Table 2. In certain embodiments, the linker moiety is a diethylene glycol linker, an iminodiacetic acid (IDA) linker, a β-Ala-iminodiaceticacid (β-Ala-IDA) linker, or a PEG linker. In particular embodiments, the N-terminus of each peptide monomer subunit is connected by the linker moiety. In particular embodiments, the C-terminus of each peptide monomer subunit is connected by the linker moiety. In certain embodiments, the linker connects an internal amino acid residue of at least one of the peptide monomer subunits to the N-terminus, C-terminus, or an internal amino acid residue of the other peptide monomer subunit.

In a further related aspect, the present invention includes a polynucleotide comprising a sequence encoding a peptide inhibitor of the present invention or one or both peptide monomer subunit of a peptide dimer inhibitor of the present invention. The present invention also included a vector comprising the polynucleotide.

In another aspect, the present invention includes a pharmaceutical composition comprising a peptide inhibitor or a peptide dimer inhibitor of the present invention, and a pharmaceutically acceptable carrier, excipient, or diluent. In particular embodiments, the pharmaceutical composition comprises an enteric coating. In certain embodiments, the enteric coating protects and releases the pharmaceutical composition within a subject's lower gastrointestinal system.

In another aspect, the present invention includes a method for treating or preventing a disease associated with IL-23 signalling, including but not limited to an Inflammatory Bowel Disease (IBD), ulcerative colitis, Crohn's disease, Celiac disease (nontropical Sprue), enteropathy associated with seronegative arthropathies, microscopic colitis, collagenous colitis, eosinophilic gastroenteritis, colitis associated with radio- or chemo-therapy, colitis associated with disorders of innate immunity as in leukocyte adhesion deficiency-1, chronic granulomatous disease, glycogen storage disease type 1b, Hermansky-Pudlak syndrome, Chediak-Higashi syndrome, and Wiskott-Aldrich Syndrome, pouchitis resulting after proctocolectomy and ileoanal anastomosis, gastrointestinal cancer, pancreatitis, insulin-dependent diabetes mellitus, mastitis, cholecystitis, cholangitis, pericholangitis, chronic bronchitis, chronic sinusitis, asthma, psoriasis, or graft versus host disease in a subject, comprising providing to the subject an effective amount of the pharmaceutical composition of the present invention. In certain embodiments, the inflammatory bowel disease is ulcerative colitis or Crohn's disease. In particular embodiments, the peptide inhibitor or the peptide dimer inhibitor inhibits binding of an interleukin-23 (IL-23) to the interleukin-23 receptor (IL-23R). In certain embodiments, the pharmaceutical composition is provided to the subject by an oral, intravenous, peritoneal, intradermal, subcutaneous, intramuscular, intrathecal, inhalation, vaporization, nebulization, sublingual, buccal, parenteral, rectal, intraocular, inhalation, vaginal, or topical route of administration. In particular embodiments, the pharmaceutical composition is provided orally for treating Inflammatory Bowel Disease (IBD), ulcerative colitis, Crohn's disease. In certain embodiments, the pharmaceutical composition is provided to the subject topically, parenterally, intravenously, subcutaneously, peritoneally, or intravenously for treating psoriasis.

BRIEF DESCRIPTION OF THE DRAWINGS

FIG. 5 is a table outlining the study design for TNBS induced colitis in rats.

FIGS. 8A-8E are graphs showing inflammation (FIG. 8A), mucosal necrosis (FIG. 8B), grand loss (FIG. 8C), colon wall thickness (FIG. 8D) and histological score (FIG. 8E) following vehicle treatment, treatment with anti-IL23p19 antibody, or treatment with the indicated amount of Compound C

FIG. 10 provides a schematic diagram depicting the structure of certain peptide inhibitors and illustrating representative types of bonds between X4 and X9.

DETAILED DESCRIPTION OF THE INVENTION

Figure 1:
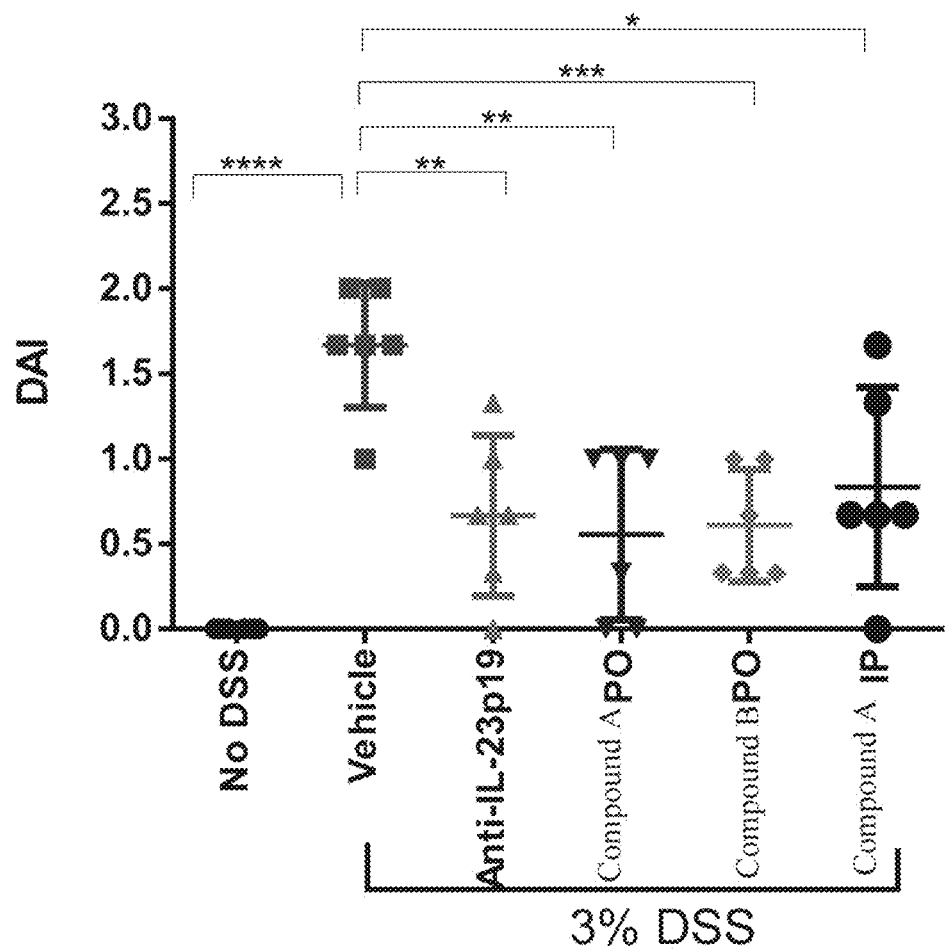
FIG. 1 provides an example of a rat IL-23 dose-response curve as measured by levels of IL-17A in the rat splenocyte assay.

Unless otherwise defined herein, scientific and technical terms used in this application shall have the meanings that are commonly understood by those of ordinary skill in the art. Generally, nomenclature used in connection with, and techniques of, chemistry, molecular biology, cell and cancer biology, immunology, microbiology, pharmacology, and protein and nucleic acid chemistry, described herein, are those well-known and commonly used in the art.

As used herein, the following terms have the meanings ascribed to them unless specified otherwise.

Throughout this specification, the word "comprise" or variations such as "comprises" or "comprising" will be understood to imply the inclusion of a stated integer (or components) or group of integers (or components), but not the exclusion of any other integer (or components) or group of integers (or components).

The singular forms "a," "an," and "the" include the plurals unless the context clearly dictates otherwise.

The term "including" is used to mean "including but not limited to." "Including" and "including but not limited to" are used interchangeably.

The terms "patient," "subject," and "individual" may be used interchangeably and refer to either a human or a non-human animal. These terms include mammals such as humans, primates, livestock animals (e.g., bovines, porcines), companion animals (e.g., canines, felines) and rodents (e.g., mice and rats).

The term "peptide," as used herein, refers broadly to a sequence of two or more amino acids joined together by peptide bonds. It should be understood that this term does not connote a specific length of a polymer of amino acids, nor is it intended to imply or distinguish whether the polypeptide is produced using recombinant techniques, chemical or enzymatic synthesis, or is naturally occurring.

The recitations "sequence identity", "percent identity", "percent homology", or, for example, comprising a "sequence 50% identical to," as used herein, refer to the extent that sequences are identical on a nucleotide-by-nucleotide basis or an amino acid-by-amino acid basis over a window of comparison. Thus, a "percentage of sequence identity" may be calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity.

Calculations of sequence similarity or sequence identity between sequences (the terms are used interchangeably herein) can be performed as follows. To determine the percent identity of two amino acid sequences, or of two nucleic acid sequences, the sequences can be aligned for optimal comparison purposes (e.g., gaps can be introduced in one or both of a first and a second amino acid or nucleic acid sequence for optimal alignment and non-homologous sequences can be disregarded for comparison purposes). In certain embodiments, the length of a reference sequence aligned for comparison purposes is at least 30%, preferably at least 40%, more preferably at least 50%, 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position.

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In some embodiments, the percent identity between two amino acid sequences is determined using the Needleman and Wunsch, (1970, J. Mol. Biol. 48: 444-453) algorithm which has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package, using an NWSgapdna.CMP matrix and a gap weight of 40, 50, 60, 70, or 80 and a length weight of 1, 2, 3, 4, 5, or 6. Another exemplary set of parameters includes a Blossum 62 scoring matrix with a gap penalty of 12, a gap extend penalty of 4, and a frameshift gap penalty of 5. The percent identity between two amino acid or nucleotide sequences can also be determined using the algorithm of E. Meyers and W. Miller (1989, Cabios, 4: 11-17) which has been incorporated into the ALIGN program (version 2.0), using a PAM120 weight residue table, a gap length penalty of 12 and a gap penalty of 4.

The peptide sequences described herein can be used as a "query sequence" to perform a search against public databases to, for example, identify other family members or related sequences. Such searches can be performed using the NBLAST and XBLAST programs (version 2.0) of Altschul, et al., (1990, J. Mol. Biol, 215: 403-10). BLAST nucleotide searches can be performed with the NBLAST program, score=100, wordlength=12 to obtain nucleotide sequences homologous to nucleic acid molecules of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al. (Nucleic Acids Res. 25:3389-3402, 1997). When utilizing BLAST and Gapped BLAST programs, the default parameters of the respective programs (e.g., XBLAST and NBLAST) can be used.

The term "conservative substitution" as used herein denotes that one or more amino acids are replaced by another, biologically similar residue. Examples include substitution of amino acid residues with similar characteristics, e.g., small amino acids, acidic amino acids, polar amino acids, basic amino acids, hydrophobic amino acids and aromatic amino acids. See, for example, the table below. In some embodiments of the invention, one or more Met residues are substituted with norleucine (Nle) which is a bioisostere for Met, but which, as opposed to Met, is not readily oxidized. Another example of a conservative substitution with a residue normally not found in endogenous, mammalian peptides and proteins is the conservative substitution of Arg or Lys with, for example, ornithine, canavanine, aminoethylcysteine or another basic amino acid. In some embodiments, one or more cysteines of a peptide analogue of the invention may be substituted with another residue, such as a serine. For further information concerning phenotypically silent substitutions in peptides and proteins, see, for example, Bowie et. al. Science 247, 1306-1310, 1990. In the scheme below, conservative substitutions of amino acids are grouped by physicochemical properties. I: neutral, hydrophilic, II: acids and amides, III: basic, IV: hydrophobic, V: aromatic, bulky amino acids.

| I | II | III | IV | V |
|---|----|-----|----|----|
| A | N | H | M | F |
| S | D | R | L | Y |
| T | E | K | I | W |
| P | Q |   | V |   |
| G |   |   | C |   |

In the scheme below, conservative substitutions of amino acids are grouped by physicochemical properties. VI: neutral or hydrophobic, VII: acidic, VIII: basic, IX: polar, X: aromatic.

| VI | VII | VIII | IX | X |
|----|-----|------|----|----|
| A | E | H | M | F |
| L | D | R | S | Y |
| I |   | K | T | W |
| P |   |   | C |   |
| G |   |   | N |   |
| V |   |   | Q |   |

The term "amino acid" or "any amino acid" as used here refers to any and all amino acids, including naturally occurring amino acids (e.g., α-amino acids), unnatural amino acids, modified amino acids, and non-natural amino acids. It includes both D- and L-amino acids. Natural amino acids include those found in nature, such as, e.g., the 23 amino acids that combine into peptide chains to form the building-blocks of a vast array of proteins. These are primarily L stereoisomers, although a few D-amino acids occur in bacterial envelopes and some antibiotics. The 20 "standard," natural amino acids are listed in the above tables. The "non-standard," natural amino acids are pyrolysine (found in methanogenic organisms and other eukaryotes), selenocysteine (present in many noneukaryotes as well as most eukaryotes), and N-formylmethionine (encoded by the start codon AUG in bacteria, mitochondria and chloroplasts). "Unnatural" or "non-natural" amino acids are non-proteinogenic amino acids (i.e., those not naturally encoded or found in the genetic code) that either occur naturally or are chemically synthesized. Over 140 unnatural amino acids are known and thousands of more combinations are possible. Examples of "unnatural" amino acids include β-amino acids ($β^3$ and $β^2$), homo-amino acids, proline and pyruvic acid derivatives, 3-substituted alanine derivatives, glycine derivatives, ring-substituted phenylalanine and tyrosine derivatives, linear core amino acids, diamino acids, D-amino acids, alpha-methyl amino acids and N-methyl amino acids. Unnatural or non-natural amino acids also include modified amino acids. "Modified" amino acids include amino acids (e.g., natural amino acids) that have been chemically modified to include a group, groups, or chemical moiety not naturally present on the amino acid. According to certain embodiments, a peptide inhibitor comprises an intramolecular bond between two amino acid residues present in the peptide inhibitor. It is understood that the amino acid residues that form the bond will be altered somewhat when bonded to each other as compared to when not bonded to each other. Reference to a particular amino acid is meant to encompass that amino acid in both its unbonded and bonded state. For example, the amino acid residue homoSerine (hSer) or homoSerine (Cl) in its unbonded form may take the form of 2-aminobutyric acid (Abu) when participating in an intramolecular bond according to the present invention. The present invention includes both peptide inhibitors containing cross-links between X4 and X9, as well as the peptide inhibitors that do not contain cross-links between X4 and X9, e.g., before cross-link formation. As such, the names hSer and Abu are intended to indicate the same amino acids and are used interchangeably.

For the most part, the names of naturally occurring and non-naturally occurring aminoacyl residues used herein follow the naming conventions suggested by the IUPAC Commission on the Nomenclature of Organic Chemistry and the IUPAC-IUB Commission on Biochemical Nomenclature as set out in "Nomenclature of α-Amino Acids (Recommendations, 1974)" Biochemistry, 14(2), (1975). To the extent that the names and abbreviations of amino acids and aminoacyl residues employed in this specification and appended claims differ from those suggestions, they will be made clear to the reader. Some abbreviations useful in describing the invention are defined below in the following Table 1A.

TABLE 1A

Abbreviations of Non-Natural Amino Acids and Chemical Moieties (for amino acid derivatives, all L unless stated)

| Abbreviation | Definition |
| --- | --- |
| Ac- | Acetyl |
| Hy | Hydrogen (Free N-terminal) |
| Dap | L-Diaminopropionic acid |
| Dab | L-Diaminobutyric acid |

TABLE 1A-continued

Abbreviations of Non-Natural Amino Acids and Chemical Moieties (for amino acid derivatives, all L unless stated)

| Abbreviation | Definition |
| --- | --- |
| Orn | L-Ornathine |
| Pen | L-Penicillamine |
| Sarc | Sarcosine |
| Cit | L-Citrulline |
| Cav | L-Cavanine |
| Phe-(4-Guanidino) | 4-Guanidine-L-Phenylalanine |
| N-MeArg | N-Methyl-L-Arginine |
| N-MeTrp | N-Methyl-L-Tryptophan |
| N-MeGln | N-Methyl-L-Glutamine |
| N-MeAla | N-Methyl-L-Alanine |
| N-MeLys | N-Methyl-Lysine |
| N-MeAsn | N-Methyl-L-Asparagine |
| 6-ChloroTrp | 6-Chloro-L-Tryptophan |
| 5-HydroxyTrp | 5-Hydroxy-L-Tryptophan |
| 1,2,3,4-tetrahydro-norharman | L-1,2,3,4-tetrahydro-norharman |
| 2-Nal (also referred to as 2-Nap) | L-2-Napthylalanine |
| 1-Nal (also referred to as 1-Nap) | L-1-Napthylalanine |
| Phe(4-OMe) | 4-Methoxy-L-phenylalanine |
| Abu | 2-Aminobutyric acid |
| Bip | L-4,4'-Biphenylalanine |
| βAla | beta-Alanine |
| βhTyr | beta homo-L-Tyrosine |
| βhTrp | beta homo-L-Trptophan |
| βhAla | beta homo-L-Alanine |
| βhLeu, | beta homo-L-Leucine |
| βhVal | beta homo-L-Valine |
| Aib | 2-aminoisobutyric acid |
| Azt | L-azetidine-2-carboxylic acid |
| Tic | (3S)-1,2,3,4-Tetrahydroisoquinoline-7-hydroxy-3-carboxylic Acid |
| Phe(4-OMe) | 4-methoxy-L-phenylalanine |
| N-Me-Lys | N-Methyl-L-Lysine |
| N-Me-Lys(Ac) | N-ε-Acetyl-D-lysine |
| $CONH_2$ | Carboxamide |
| COOH | Acid |
| 3-Pal | L-3-Pyridylalanine |
| Phe(4-F) | 4-Fluoro-L-Phenylalanine |
| DMT | 2,6-DimethylTyrosine |
| Phe(4-OMe) | 4-Methoxyphenylalanine |
| hLeu | L-homoLeucine |
| hArg | L-homoArginine |
| α-MeLys | alpha-methyl-L-Lysine |
| α-MeOrn | alpha-methyl-L-Ornathine |
| α-MeLeu | alpha-methyl-L-Leucine |
| α-MeTrp | alpha-methyl-L-Tryptophan |
| α-MePhe | alpha-methyl-L-Phenylalanine |
| α-MeTyr | alpha-methyl-L-Tyrosine |
| α-DiethylGly | α-DiethylGlycine |
| Lys(Ac) | N-ε-acetyl-L-Lysine |
| DTT | Dithiothreotol |
| Nle | L-Norleucine |
| βhTrp | L-β-homoTrypophan |
| βhPhe | L-β-homophenylalanine |
| βhPro | L-β-homoproline |
| Phe(4-$CF_3$) | 4-Trifluoromethyl-L-Phenylalanine |
| β-Glu | L-β-Glutamic acid |
| βhGlu | L-β-homoglutamic acid |
| 2-2-Indane | 2-Aminoindane-2-carboxylic acid |
| 1-1-Indane | 1-Aminoindane-1-carboxylic acid |
| hCha | L-homocyclohexylalanine |
| Cyclobutyl | L-cyclobutylalanine |
| βhPhe | L-β-homo-phenylalanine |
| Gla | Gama-Carboxy-L-Glutamic acid |
| Cpa | Cyclopentyl-L-alanine |
| Cha | Cyclohexyl-L-alanine |
| Octgly | L-Octylglycine |
| t-butyl-Ala | 3-(tert-butyl)-L-Ala-OH |
| t-butyl-Gly | tert-butyl-glycine |
| AEP | 3-(2-aminoethoxy)propanoic acid |
| AEA | (2-aminoethoxy)acetic acid |
| Phe(4-Phenoxy)] | 4-Phenoxy-L-phenylalanine |
| Phe(4-OBzl) | O-Benzyl-L-tyrosine |
| Phe(4-$CONH_2$) | 4-Carbamoyl-L-phenylalanine |

TABLE 1A-continued

Abbreviations of Non-Natural Amino Acids and Chemical Moieties
(for amino acid derivatives, all L unless stated)

| Abbreviation | Definition |
|---|---|
| Phe(4-CO$_2$H) | 4-Carboxy-L-phenylalanine |
| Phe(3,4-Cl$_2$) | 3,4 dichloro-L-phenylalanine |
| Tyr(3-t-Bu) | 3-t-butyl-L-tyrosine |
| Phe(t-Bu) | t-butyl-L-phenylalanine |
| Phe[4-(2-aminoethoxy)] | 4-(2-aminoethoxy)-L-phenylalanine |
| Phe(4-CN) | 4-cyano-L-phenylalanine |
| Phe(4-Br) | 4-bromo-L-phenylalanine |
| Phe(4-NH$_2$) | 4-amino-L-phenylalanine |
| Phe(4-Me) | 4-methyl-L-phenylalanine |
| 4-Pyridylalanine | 4-L-Pyridylalanine |
| 4-amino-4-carboxy-piperidine | 4-amino-4-carboxy-piperidine |
| hPh(3,4-dimethoxy) | 3,4-dimethoxy-L-homophenylalanine |
| Phe(2,4-Me$_2$) | 2,4-dimethyl-L-phenylalanine |
| Phe(3,5-F$_2$) | 3,4-difluoro-L-phenylalanine |
| Phe(penta-F) | pentafluoro-L-phenylalanine |
| 2,5,7-tert butyl Trp | 2,5,7-Tris-tert-butyl-L-tryptophan |
| Tic | L-1,2,3,4-tetrahydro-isoquinoline-3-carboxylic acid |
| Phe(4-OAllyl) | O-Allyl-L-Tyrosine |
| Phe(4-N$_3$) | 4-azidophenylalanine |
| Achc | 1-aminocyclohexanecarboxylic acid |
| Acvc | 1-aminocyclopentanecarboxylic acid |
| Acbc | 1-aminocyclobutanecarboxylic acid |
| Acpc | 1-aminocyclopropylcarboxylic acid |
| 4-amino-4-carboxy-tetrahydropyran (also referred as THP) | 4-amino-4-carboxy-tetrahydropropan |

Throughout the present specification, unless naturally occurring amino acids are referred to by their full name (e.g. alanine, arginine, etc.), they are designated by their conventional three-letter or single-letter abbreviations (e.g. Ala or A for alanine, Arg or R for arginine, etc.). Unless otherwise indicated, three-letter and single-letter abbreviations of amino acids refer to the L-isomeric form of the amino acid in question. The term "L-amino acid," as used herein, refers to the "L" isomeric form of a peptide, and conversely the term "D-amino acid" refers to the "D" isomeric form of a peptide (e.g., Dasp, (D)Asp or D-Asp; Dphe, (D)Phe or D-Phe). Amino acid residues in the D isomeric form can be substituted for any L-amino acid residue, as long as the desired function is retained by the peptide. D-amino acids may be indicated as customary in lower case when referred to using single-letter abbreviations.

In the case of less common or non-naturally occurring amino acids, unless they are referred to by their full name (e.g. sarcosine, ornithine, etc.), frequently employed three- or four-character codes are employed for residues thereof, including, Sar or Sarc (sarcosine, i.e. N-methylglycine), Aib (α-aminoisobutyric acid), Dab (2,4-diaminobutanoic acid), Dapa (2,3-diaminopropanoic acid), γ-Glu (γ-glutamic acid), Gaba (γ-aminobutanoic acid), β-Pro (pyrrolidine-3-carboxylic acid), and 8Ado (8-amino-3,6-dioxaoctanoic acid), Abu (2-amino butyric acid), βhPro (β-homoproline), βhPhe(β-homophenylalanine) and Bip (β,β diphenylalanine), and Ida (Iminodiacetic acid).

As is clear to the skilled artisan, the peptide sequences disclosed herein are shown proceeding from left to right, with the left end of the sequence being the N-terminus of the peptide and the right end of the sequence being the C-terminus of the peptide. Among sequences disclosed herein are sequences incorporating a "Hy-" moiety at the amino terminus (N-terminus) of the sequence, and either an "—OH" moiety or an "—NH$_2$" moiety at the carboxy terminus (C-terminus) of the sequence. In such cases, and unless otherwise indicated, a "Hy-" moiety at the N-terminus of the sequence in question indicates a hydrogen atom, corresponding to the presence of a free primary or secondary amino group at the N-terminus, while an "—OH" or an "—NH$_2$" moiety at the C-terminus of the sequence indicates a hydroxy group or an amino group, corresponding to the presence of an amido (CONH$_2$) group at the C-terminus, respectively. In each sequence of the invention, a C-terminal "—OH" moiety may be substituted for a C-terminal "—NH$_2$" moiety, and vice-versa.

The term "DRP," as used herein, refers to disulfide rich peptides.

The term "dimer," as used herein, refers broadly to a peptide comprising two or more monomer subunits. Certain dimers comprise two DRPs. Dimers of the present invention include homodimers and heterodimers. A monomer subunit of a dimer may be linked at its C- or N-terminus, or it may be linked via internal amino acid residues. Each monomer subunit of a dimer may be linked through the same site, or each may be linked through a different site (e.g., C-terminus, N-terminus, or internal site).

The term "NH$_2$," as used herein, refers to a free amino group present at the amino terminus of a polypeptide. The term "OH," as used herein, refers to a free carboxy group present at the carboxy terminus of a peptide. Further, the term "Ac," as used herein, refers to Acetyl protection through acylation of the C- or N-terminus of a polypeptide.

The term "carboxy," as used herein, refers to —CO$_2$H.

The term "isostere replacement," as used herein, refers to any amino acid or other analog moiety having chemical and/or structural properties similar to a specified amino acid.

The term "cyclized," as used herein, refers to a reaction in which one part of a polypeptide molecule becomes linked to another part of the polypeptide molecule to form a closed ring, such as by forming a disulfide bridge or other similar bond.

The term "subunit," as used herein, refers to one of a pair of polypeptide monomers that are joined to form a dimer peptide composition.

The term "linker moiety," as used herein, refers broadly to a chemical structure that is capable of linking or joining together two peptide monomer subunits to form a dimer.

The term "pharmaceutically acceptable salt," as used herein, represents salts or zwitterionic forms of the peptides or compounds of the present invention which are water or oil-soluble or dispersible, which are suitable for treatment of diseases without undue toxicity, irritation, and allergic response; which are commensurate with a reasonable benefit/risk ratio, and which are effective for their intended use. The salts can be prepared during the final isolation and purification of the compounds or separately by reacting an amino group with a suitable acid. Representative acid addition salts include acetate, adipate, alginate, citrate, aspartate, benzoate, benzenesulfonate, bisulfate, butyrate, camphorate, camphorsulfonate, digluconate, glycerophosphate, hemisulfate, heptanoate, hexanoate, formate, fumarate, hydrochloride, hydrobromide, hydroiodide, 2-hydroxyethanesulfonate (isethionate), lactate, maleate, mesitylenesulfonate, methanesulfonate, naphthalenesulfonate, nicotinate, 2-naphthalenesulfonate, oxalate, pamoate, pectinate, persulfate, 3-phenylpropionate, picrate, pivalate, propionate, succinate, tartrate, trichloroacetate, trifluoroacetate, phosphate, glutamate, bicarbonate, para-toluenesulfonate, and undecanoate. Also, amino groups in the compounds of the present invention can be quaternized with methyl, ethyl, propyl, and butyl chlorides, bromides, and iodides; dimethyl, diethyl, dibutyl, and diamyl sulfates; decyl, lauryl, myristyl, and steryl chlorides, bromides, and iodides; and benzyl and phenethyl bromides. Examples of acids which can be employed to form therapeutically acceptable addition salts include inorganic acids such as hydrochloric, hydrobromic, sulfuric, and phosphoric, and organic acids such as oxalic, maleic, succinic, and citric. A pharmaceutically acceptable salt may suitably be a salt chosen, e.g., among acid addition salts and basic salts. Examples of acid addition salts include chloride salts, citrate salts and acetate salts. Examples of basic salts include salts where the cation is selected among alkali metal cations, such as sodium or potassium ions, alkaline earth metal cations, such as calcium or magnesium ions, as well as substituted ammonium ions, such as ions of the type N(R1)(R2)(R3)(R4)+, where R1, R2, R3 and R4 independently will typically designate hydrogen, optionally substituted C1-6-alkyl or optionally substituted C2-6-alkenyl. Examples of relevant C1-6-alkyl groups include methyl, ethyl, 1-propyl and 2-propyl groups. Examples of C2-6-alkenyl groups of possible relevance include ethenyl, 1-propenyl and 2-propenyl. Other examples of pharmaceutically acceptable salts are described in "Remington's Pharmaceutical Sciences", 17th edition, Alfonso R. Gennaro (Ed.), Mark Publishing Company, Easton, Pa., USA, 1985 (and more recent editions thereof), in the "Encyclopaedia of Pharmaceutical Technology", 3rd edition, James Swarbrick (Ed.), Informa Healthcare USA (Inc.), NY, USA, 2007, and in J. Pharm. Sci. 66: 2 (1977). Also, for a review on suitable salts, see *Handbook of Pharmaceutical Salts: Properties, Selection, and Use* by Stahl and Wermuth (Wiley-VCH, 2002). Other suitable base salts are formed from bases which form non-toxic salts. Representative examples include the aluminum, arginine, benzathine, calcium, choline, diethylamine, diolamine, glycine, lysine, magnesium, meglumine, olamine, potassium, sodium, tromethamine, and zinc salts. Hemisalts of acids and bases may also be formed, e.g., hemisulphate and hemicalcium salts.

The term "N(alpha)Methylation", as used herein, describes the methylation of the alpha amine of an amino acid, also generally termed as an N-methylation.

The term "sym methylation" or "Arg-Me-sym", as used herein, describes the symmetrical methylation of the two nitrogens of the guanidine group of arginine. Further, the term "asym methylation" or "Arg-Me-asym" describes the methylation of a single nitrogen of the guanidine group of arginine.

The term "acylating organic compounds", as used herein refers to various compounds with carboxylic acid functionality that are used to acylate the N-terminus of an amino acid or a monomer or dimer, e.g., a monomer subunit prior to forming a C-terminal dimer. Non-limiting examples of acylating organic compounds include cyclopropylacetic acid, 4-Fluorobenzoic acid, 4-fluorophenylacetic acid, 3-Phenylpropionic acid, Succinic acid, Glutaric acid, Cyclopentane carboxylic acid, 3,3,3-trifluoropropionic acid, 3-Fluoromethylbutyric acid, Tetrahedro-2H-Pyran-4-carboxylic acid.

The term "alkyl" includes a straight chain or branched, noncyclic or cyclic, saturated aliphatic hydrocarbon containing from 1 to 24 carbon atoms. Representative saturated straight chain alkyls include, but are not limited to, methyl, ethyl, n-propyl, n-butyl, n-pentyl, n-hexyl, and the like, while saturated branched alkyls include, without limitation, isopropyl, sec-butyl, isobutyl, tert-butyl, isopentyl, and the like. Representative saturated cyclic alkyls include, but are not limited to, cyclopropyl, cyclobutyl, cyclopentyl, cyclohexyl, and the like, while unsaturated cyclic alkyls include, without limitation, cyclopentenyl, cyclohexenyl, and the like.

The term "mammal" refers to any mammalian species such as a human, mouse, rat, dog, cat, hamster, guinea pig, rabbit, livestock, and the like.

As used herein, a "therapeutically effective amount" of the peptide inhibitor of the invention is meant to describe a sufficient amount of the peptide inhibitor to treat an IL-23/IL-23R-related disease, including but not limited to any of the diseases and disorders described herein (for example, to reduce inflammation associated with IBD). In particular embodiments, the therapeutically effective amount will achieve a desired benefit/risk ratio applicable to any medical treatment.

An "analog" of an amino acid, e.g., a "Phe analog" or a "Tyr analog" means an analog of the referenced amino acid. A variety of amino acid analogs are known and available in the art, including Phe and Tyr analogs. In certain embodiments, an amino acid analog, e.g., a Phe analog or a Tyr analog comprises one, two, three, four or five substitutions as compared to Phe or Tyr, respectively. In certain embodiments, the substitutions are present in the side chains of the amino acids. In certain embodiments, a Phe analog has the structure Phe($R^2$), wherein $R^2$ is a Hy, OH, $CH_3$, $CO_2H$, $CONH_2$, $CONH_2OCH_2CH_2NH_2$, t-Bu, $OCH_2CH_2NH_2$, phenoxy, $OCH_3$, OAllyl, Br, Cl, F, $NH_2$, N3, or guanadino. In certain embodiments, $R^2$ is $CONH_2OCH_2CH_2NH_2$, $OCH_3$, $CONH_2$, $OCH_3$ or $CO_2H$. Examples of Phe analogs include, but are not limited to: hPhe, Phe(4-OMe), α-Me-Phe, hPhe(3,4-dimethoxy), Phe(4-$CONH_2$), Phe(4-phenoxy), Phe(4-guanadino), Phe(4-tBu), Phe(4-CN), Phe(4-Br), Phe(4-OBzl), Phe(4-$NH_2$), BhPhe(4-F), Phe(4-F), Phe (3,5 DiF), Phe($CH_2CO_2H$), Phe(penta-F), Phe(3,4-$Cl_2$), Phe (3,4-$F_2$), Phe(4-$CF_3$), ββ-diPheAla, Phe(4-$N_3$), Phe[4-(2-aminoethoxy)], 4-Phenylbenzylalanine, Phe(4-$CONH_2$), Phe(3,4-Dimethoxy), Phe(4-$CF_3$), Phe(2,3-$Cl_2$), and Phe(2, 3-$F_2$). Examples of Tyr analogs include, but are not limited to: hTyr, N-Me-Tyr, Tyr(3-tBu), Tyr(4-$N_3$) and βhTyr.

Peptide Inhibitors of IL-23R

Genome-wide association studies (GWAS) have demonstrated significant association of the IL-23 receptor (IL-23R) gene with inflammatory bowel disease (IBD), suggesting that perturbation of IL-23 signaling could be relevant to the pathogenesis of the disease. The present invention provides compositions and methods to modulate the IL-23 pathway through selective antagonism of IL-23R by oral treatment with peptides that are stable and restricted to the gastrointestinal (GI) tissue. Novel inhibitory peptides that are uniquely resistant to oxidative/reductive conditions and proteolytic degradation in a variety of assays that mimic the various compartments of the GI environment were identified. Functionally, these peptides potently neutralize IL-23-mediated signaling in a transformed human cell line and in human primary cells. The binding of IL-23R is selective, since the peptides do not block the interaction between IL-6 to IL-6R or antagonize the IL-12 signaling pathway. Furthermore, these orally delivered peptides are efficacious in attenuating colitis in a 2,4,6-trinitrobenzenesulfonic acid (TNBS)-induced acute rat model of IBD, as shown by a significant reduction in the ratio of colon weight to length, colon macroscopic score, neutrophil infiltration, and histopathology comparable to that of the control anti-IL-23p19 mAb.

The present invention relates generally to peptides that have IL-23R antagonist activity, including both peptide monomers and peptide dimers. In certain embodiments, this invention demonstrates a new paradigm for treatment of IBD and other diseases and disorders by oral delivery of antagonists of IL-23. IBD represents a local inflammation of the intestinal tissue; therefore, advantageous therapeutic agents would act from the luminal side of the intestine, yielding high drug concentrations in diseased tissue, minimizing systemic availability and resulting in improved efficacy and safety when compared to systemic approaches. Oral administration of the compounds of the present invention is expected to maximize drug levels in diseased intestinal tissues while limiting drug concentrations in circulation, thereby providing efficacious, safe, and durable delivery for life-long treatment of IBD and other diseases and disorders.

In certain embodiments, the present invention relates to various peptides, or peptide dimers comprising hetero- or homo-monomer subunits, that form cyclized structures through disulfide or other bonds. In certain embodiments, the disulfide or other bonds are intramolecular bonds. The cyclized structure of the peptide monomer inhibitors and the monomer subunits of the peptide dimer inhibitors has been shown to increase potency and selectivity of the peptide inhibitors. In certain embodiments, a peptide dimer inhibitor may include one or more intermolecular bonds linking the two monomer peptide subunits within the peptide dimer inhibitor, e.g., an intermolecular bridge between two cysteine residues, one in each peptide monomer subunit.

The present invention provides peptide inhibitors that bind to IL-23R, which may be monomers or dimers. In particular embodiments, the peptide inhibitors inhibit the binding of IL-23 to IL-23R. In certain embodiments, the IL-23R is human IL-23R, and the IL-23 is human IL-23. In certain embodiments, a peptide inhibitor of the present invention reduces IL-23 binding to IL-23R by at least 20%, at least 30%, at least 40%, at least 50%, at least 60%, at least 70%, at least 80%, or at least 90% as compared to a negative control peptide. Methods of determining binding are known in the art and include ELISA assays, as described in the accompanying Examples.

In certain embodiments, a peptide inhibitor of the present invention has an IC50 of >1 mM, <1 mM, 500 nM to 1000 nM, <500 nM, <250 nM, <100 nM, <50 nM, <25 nM, <10 nM, or <5 mM, e.g., for inhibiting binding of IL-23 to IL-23R (e.g., human IL-23 and human IL-23R). Methods of determining activity are known in the art and include any of those described in the accompanying Examples.

In certain embodiments, a peptide inhibitor of the present invention has increased stability, increased gastrointestinal stability, or increased stability in stimulated intestinal fluid (SIF) or simulated gastric fluid (SGF), and/or under redox conditions (e.g., DTT) as compared to a control peptide. In certain embodiments, a control peptide is an unrelated peptide of the same or similar length. In particular embodiments, a control peptide is a peptide having the identical or a highly related amino acid sequence (e.g., >90% sequence identity) as the peptide inhibitor. In particular embodiments, a control peptide is a peptide having the identical or a highly related amino acid sequence (e.g., >90% sequence identity) as the peptide inhibitor, but which does not have a cyclized structure, e.g., through an intramolecular bond between two amino acid residues within the control peptide, or which is not dimerized, or which does not comprise a conjugate for stabilization. In particular embodiments, the only difference between the peptide inhibitor and the control peptide is that the peptide inhibitor comprises one or more amino acid substitutions that introduce one or more amino acid residues into the peptide inhibitor, wherein the introduced amino residue(s) forms an intrasulfide disulfide or thioether bond with another amino acid residue in the peptide inhibitor. One example of a control for a peptide dimer inhibitor is a monomer having the same sequence as one of the monomer subunits present in the peptide dimer inhibitor. One example of a control for a peptide inhibitor comprising a conjugate is a peptide having the same sequence but not including the conjugated moiety. In certain embodiments, a control peptide is a peptide (e.g., a naturally-occurring peptide) corresponding to a region of IL-23 that binds to IL-23R.

Methods of determining the stability of a peptide are known in the art. In certain embodiments, the stability of a peptide inhibitor is determined using an SIF assay, e.g., as described in Example 3. In certain embodiments, the stability of a peptide inhibitor is determined using an SGF assay, e.g., as described in Example 3. In particular embodiments, a peptide inhibitor has a half-life (e.g., in SIF or SGF or DTT) under a given set of conditions (e.g., temperature) of greater than 1 minute, greater than 10 minutes, greater than 20 minutes, greater than 30 minutes, greater than 60 minutes, greater than 90 minutes, greater than 120 minutes, greater than 3 hours, or greater than four hours when exposed to SIF or SGF or DTT. In certain embodiments, the temperature is about 25° C., about 4° C., or about 37° C., and the pH is a physiological pH, or a pH about 7.4.

In some embodiments, the half-life is measured in vitro using any suitable method known in the art, e.g., in some embodiments, the stability of a peptide of the present invention is determined by incubating the peptide with pre-warmed human serum (Sigma) at 37° C. Samples are taken at various time points, typically up to 24 hours, and the stability of the sample is analyzed by separating the peptide or peptide dimer from the serum proteins and then analyzing for the presence of the peptide or peptide dimer of interest using LC-MS.

In some embodiments, a peptide inhibitor of the present invention exhibits improved solubility or improved aggregation characteristics as compared to a control peptide. Solubility may be determined via any suitable method known in the art. In some embodiments, suitable methods known in the art for determining solubility include incubating peptides in various buffers (Acetate pH4.0, Acetate pH5.0, Phos/Citrate pH5.0, Phos Citrate pH6.0, Phos pH 6.0, Phos pH 7.0, Phos pH7.5, Strong PBS pH 7.5, Tris pH7.5, Tris pH 8.0, Glycine pH 9.0, Water, Acetic acid (pH 5.0 and other known in the art) and testing for aggregation or solubility using standard techniques. These include, but are not limited to, visual precipitation, dynamic light scattering, Circular Dichroism and fluorescent dyes to measure surface hydrophobicity, and detect aggregation or fibrillation, for example. In some embodiments, improved solubility means the peptide is more soluble in a given liquid than is a control peptide. In some embodiments, improved aggregation means the peptide has less aggregation in a given liquid under a given set of conditions than a control peptide.

In certain embodiments advantageous for achieving high compound concentrations in intestinal tissues when delivered orally, peptide inhibitors of the present invention are stable in the gastrointestinal (GI) environment. Proteolytic metabolism in the GI tract is driven by enzymes (including pepsins, trypsin, chymotrypsin, elastase, aminopeptidases, and carboxypeptidase AB) that are secreted from the pancreas into the lumen or are produced as brush border enzymes. Proteases typically cleave peptides and proteins that are in an extended conformation. In the reducing environment of intestinal fluids, disulfide bonds may be broken, resulting in a linear peptide and rapid proteolysis. This luminal redox environment is largely determined by the Cys/CySS redox cycle. In enterocytes, relevant activities include numerous digestive enzymes such as CYP450 and UDP-glucuronsyl-transferase. Finally, bacteria, present in the large intestine at concentration ranging from $10^{10}$ to $10^{12}$ CFU/ml, constitute another metabolic barrier. In certain embodiments, the peptide inhibitors are stable to various pHs that range from strongly acidic in the stomach (pH 1.5-1.9), trending towards basic in the small intestine (pH 6-7.5), and then weakly acidic in the colon (pH 5-7). Such peptide inhibitors are stable during their transit through the various GI compartments, a process that has been estimated to take 3-4 h in the intestine and 6-48 h in the colon.

In some embodiments, the peptide inhibitors of the present invention have less degradation, e.g., over a period of time (i.e., more degradation stability), e.g., greater than or about 10% less, greater than or about 20% less, greater than or about 30% less, greater than or about 40 less, or greater than or about 50% less degradation than a control peptide. In some embodiments, degradation stability is determined via any suitable method known in the art. In some embodiments, the degradation is enzymatic degradation. For example, in certain embodiments, the peptide inhibitors have reduced susceptibility to degradation by trypsin, chromotrypsin or elastase. In some embodiments, suitable methods known in the art for determining degradation stability include the method described in Hawe et al., J Pharm Sci, VOL. 101, No. 3, 2012, p 895-913, incorporated herein in its entirety. Such methods are in some embodiments used to select potent peptide sequences with enhanced shelf lives. In particular embodiments, peptide stability is determined using a SIF assay or SGF assay as described herein.

In certain embodiments, peptide inhibitors of the present invention inhibit or reduce IL-23-mediated inflammation. In related embodiments, peptide inhibitors of the present invention inhibit or reduce IL-23-mediated secretion of one or more cytokines, e.g., by binding to IL-23R on the cell surface, thus inhibiting IL-23 binding to the cell. In particular embodiments, peptide inhibitors of the present invention inhibit or reduce IL-23-mediated activation of Jak2, Tyk2, Stat1, Stat3, Stat4, or Stat5. Methods of determining inhibition of cytokine secretion and inhibition of signaling molecules are known in the art. For example, inhibition of IL-23/IL-23R signaling may be determined by measuring inhibition of phospho-Stat3 levels in cell lysates, as described in the accompanying Examples, including Example 2.

In certain embodiments, peptide inhibitors of the present invention inhibit or reduce IL-23-mediated inflammation. In related embodiments, peptide inhibitors of the present invention inhibit or reduce IL-23-mediated secretion of one or more cytokines, e.g., by binding to IL-23R on the cell surface, thus inhibiting IL-23 binding to the cell. In particular embodiments, peptide inhibitors of the present invention inhibit or reduce IL-23-mediated activation of Jak2, Tyk2, Stat1, Stat3, Stat4, or Stat5. Methods of determining inhibition of cytokine secretion and inhibition of signaling molecules are known in the art. For example, inhibition of IL-23/IL-23R signaling may be determined by measuring inhibition of phospho-Stat3 levels in cell lysates, as described in the accompanying Examples, including Example 2.

In certain embodiments, peptide inhibitors have increased redox stability as compared to a control peptide. A variety of assays that may be used to determine redox stability are known and available in the art. Any of these may be used to determine the redox stability of peptide inhibitors of the present invention.

In certain embodiments, the present invention provides various peptide inhibitors that bind or associate with the IL-23R, in vitro or in vivo, to disrupt or block binding between IL-23 and IL-23R. In certain embodiments, the peptide inhibitors bind and/or inhibit human IL-23R. In certain embodiments, the peptide inhibitors bind and/or inhibit both human and rodent IL-23R. In certain embodiments, the peptide inhibitors bind and/or inhibit both human and rat IL-23R. In particular embodiments, the peptide inhibitors inhibit rat IL-23R at least 50%, at least 60%, at least 70%, at least 80%, at least 90%, or at least 95% as well as they bind or inhibit human IL-23R, e.g., as determined by an assay described herein. In certain embodiments, the peptide inhibitors preferentially bind and/or inhibit human and/or rat IL-23R as compared to mouse IL-23R. In particular embodiments, the peptide inhibitors preferentially bind to rat IL-23R as compared to mouse IL-23R. In particular embodiments, the peptide inhibitors preferentially bind to human IL-23R as compared to mouse IL-23R. In certain embodiments, binding of a peptide inhibitor to mouse IL-23R is less than 75%, less than 50%, less than 40%, less than 30%, less than 20%, or less than 10% of binding of the same peptide inhibitor to human IL-23R and/or rat IL-23R. In certain embodiments of peptide inhibitors that preferentially bind and/or inhibit human IL-23R and/or rat IL-23R as compared to mouse IL-23R, the peptide inhibitor binds to a region of IL-23R that is disrupted by the presence of additional amino acids present in mouse IL-23R but not human IL-23R or rat IL-23. In one embodiment, the additional amino acids present in the mouse IL-23R are in the region corresponding to about amino acid residue 315 to about amino acid residue 340 of the mouse IL23R protein, e.g., amino acid region NWQPWSSPFVHQTSQETGKR (SEQ ID NO: 261). In particular embodiments, the peptide inhibitors bind to a region of human IL-23R from about amino acid 230 to about amino acid residue 370.

In certain embodiments, peptide inhibitors show GI-restricted localization following oral administration. In particular embodiments, greater than 50%, greater than 60%, greater than 70%, greater than 80%, or greater than 90% of orally administered peptide inhibitor is localized to gastro-intestinal organs and tissues. In particular embodiments, blood plasma levels of orally administered peptide inhibitor are less than 20%, less than 10%, less than 5%, less than 2%, less than 1% or less than 0.5% the levels of peptide inhibitor found in the small intestine mucosa, colon mucosa, or proximal colon.

The various peptide inhibitors of the invention may be constructed solely of natural amino acids. Alternatively, the peptide inhibitors may include non-natural amino acids including, but not limited to, modified amino acids. In certain embodiments, modified amino acids include natural amino acids that have been chemically modified to include a group, groups, or chemical moiety not naturally present on the amino acid. The peptide inhibitors of the invention may additionally include one or more D-amino acids. Still further, the peptide inhibitors of the invention may include amino acid analogs.

In certain embodiments, peptide inhibitors of the present invention include one or more modified or unnatural amino acids. For example, in certain embodiments, a peptide inhibitor includes one or more of Dab, Dap, Pen, Sarc, Cit, Cav, hLeu, 2-Nal, D-1-Nal, D-2-Nal, Phe(4-OMe), βhTrp, α-MePhe, α-MeTyr, α-MeTrp, β-HPhe, Phe(4-CF$_3$), 2-2-Indane, 1-1-Indane, Cyclobutyl, β-hPhe, Gla, Phe(4-NH$_2$), hPhe, 1-Nal, Nle, homoamino acids, D-amino acids, 4,4'-Biphenylalanine (Bip), cyclobutyl-Ala, hCha, βhPhe, βGlu, Phe(4-Guanidino), Phe[4-(2-aminoethoxy)], Phe[4-(2-acetylaminoethoxy)], Phe(4-CONH$_2$), Phe(4-Me), Tyr(Bzl), or Tyr(Me), Phe(3,4-diF$_2$), Phe(3,4-Cl$_2$), Phe(3-Me), Phe[4-(2-aminoethoxy)], Phe[4-(2-acetylaminoethoxy)], Phe(Br), Phe(4-CONH$_2$), Phe(Cl), Phe(4-CN), Phe(4-guadino), Phe (4-Me), Phe(4-NH$_2$), Phe(4-N3), Tyr, Tyr(Bzl), or Tyr(Me), Phe(3,4-dimethoxy), 5-HydroxyTrp, Phe(3,4-Cl$_2$), Tyr(3-tBu), and various N-methylated amino acids and alpha-methyl amino acids. In some embodiments of the present invention, a peptide inhibitor includes one or more non-natural amino acids shown in Table 1A. One having skill in the art will appreciate that other modified or unnatural amino acids, and various other substitutions of natural amino acids with modified or unnatural amino acids, may be made to achieve similar desired results, and such substitutions are within the teaching and spirit of the present invention. In certain embodiments, peptide inhibitors of the present invention include any of those described herein, including but not limited to any of those comprising an amino acid sequence or peptide inhibitor structure shown in any one of the tables herein, including Tables 3A-3H, 4A, 4B, 5A-5C, 6, or 7-18, or the accompanying figures, wherein one or more residues is substituted with a modified or unnatural amino acid.

The present invention also includes any of the peptide inhibitors described herein in either a free or a salt form. Thus, embodiments of any of the peptide inhibitors described herein (and related methods of use thereof) include a pharmaceutically acceptable salt of the peptide inhibitor.

The present invention also includes variants of any of the peptide inhibitors described herein, including but not limited to any of those comprising a sequence shown in any one of Tables 3A-3H, 4A, 4B, 5A-5C, 6, or 7-18, wherein one or more L-amino acid residue is substituted with the D isomeric form of the amino acid residue, e.g., an L-Ala is substituted with a D-Ala.

In particular embodiments of the peptide inhibitors described herein, they comprise one or more unnatural or non-natural amino acid residue.

The present invention also includes any of the peptide monomer inhibitors described herein linked to a linker moiety, including any of the specific linker moieties described herein. In particular embodiments, a linker is attached to an N-terminal or C-terminal amino acid, while in other embodiments, a linker is attached to an internal amino acid. In particular embodiments, a linker is attached to two internal amino acids, e.g., an internal amino acid in each of two monomer subunits that form a dimer. In some embodiments of the present invention, a peptide inhibitor is attached to one or more linker moieties shown in Tables 2A or 2B.

The present invention also includes peptides comprising a peptide monomer subunit having at least 90%, at least 95%, at least 98%, or at least 99% sequence identity to a peptide inhibitor described herein.

In certain embodiments, a peptide inhibitor or a monomer subunit of a peptide inhibitor of the present invention comprises, consists essentially of, or consists of 7 to 35 amino acid residues, 8 to 35 amino acid residues, 9 to 35 amino acid residues, 10 to 35 amino acid residues, 7 to 25 amino acid residues, 8 to 25 amino acid residues, 9 to 25 amino acid residues, 10 to 25 amino acid residues, 7 to 20 amino acid residues, 8 to 20 amino acid residues, 9 to 20 amino acid residues, 10 to 20 amino acid residues, 7 to 18 amino acid residues, 8 to 18 amino acid residues, 9 to 18 amino acid residues, or 10 to 18 amino acid residues, and, optionally, one or more additional non-amino acid moieties, such as a conjugated chemical moiety, e.g., a PEG or linker moiety. In particular embodiments, a peptide inhibitor of the present invention (or a monomer subunit thereof), including but not limited to those of any embodiment of Formula I, Formula II, Formula III, Formula IV, Formula V or Formula VI is greater than 10, greater than 12, greater than 15, greater than 20, greater than 25, greater than 30 or greater than 35 amino acids, e.g., 35 to 50 amino acids. In certain embodiments, a peptide inhibitor (or a monomer subunit thereof) is less than 50, less than 35, less than 30, less than 25, less than 20, less than 15, less than 12, or less than 10 amino acids. In particular embodiments, a monomer subunit of a peptide inhibitor (or a peptide monomer inhibitor) comprises or consists of 7, 8, 9, 10, 11, 12, 13, 14, 15, 16, 17, 18, 19, 20, 21, 22, 23, 24, 25, 26, 27, 28, 29, 30, 31, 32, 33, 34, or 35 amino acid residues. In particular embodiments, a monomer subunit of a peptide inhibitor of the present invention comprises or consists of 10 to 18 amino acid residues and, optionally, one or more additional non-amino acid moieties, such as a conjugated chemical moiety, e.g., a PEG or linker moiety. In various embodiments, the monomer subunit comprises or consists of 7 to 35 amino acid residues, 7 to 20 amino acid residues, 8 to 20 amino acid residues, 9 to 20 amino acid residues, 10 to 20 amino acid residues, 8 to 18 amino acid residues, 8 to 19 amino acid residues, 8 to 18 amino acid residues, 9 to 18 amino acid residues, or 10 to 18 amino acid residues. In particular embodiments of any of the various Formulas described herein, X comprises or consists of 7 to 35 amino acid residues, 8 to 35 amino acid residues, 9 to 35 amino acid residues, 10 to 35 amino acid residues, 7 to 25 amino acid residues, 8 to 25 amino acid residues, 9 to 25 amino acid residues, 10 to 25 amino acid residues, 7 to 18 amino acid residues, 8 to 18 amino acid residues, 9 to 18 amino acid residues, or 10 to 18 amino acid residues.

Certain illustrative peptide inhibitors described herein comprise 12 or more amino acid residues. However, the present invention also includes peptide inhibitors comprising a fragment of any of the peptide sequences described herein, including peptide inhibitors having 7, 8, 9, 10, or 11 amino acid residues. For example, peptide inhibitors of the present invention include peptides comprising or consisting of X4-X9, X4-X10, X4-X11, X4-X12, X4-X13, X4-X14, X4-X15, or X4-X16. In particular embodiments, the present invention includes peptide inhibitors having any of the sequences described herein, including but not limited to, those shown in Ix, Ia-It, IIa-IId, IIIa-IIIe, Iva, IVb, V or VI, or any of the tables provided herein, wherein one or more of X10, X11, X12, X13, X14, X15, or X16 is absent. In particular embodiments, one or more of X13, X14, X15 or X16 is absent.

In particular embodiments of the present invention, the peptide inhibitors, or X regions thereof, are not present within an antibody. In particular embodiments, the peptide inhibitors, or X regions thereof, are not present within a $V_H$ or $V_L$ region of an antibody.

In particular embodiments of the peptide inhibitors described herein, they comprise one or more unnatural or non-natural amino acid residue.

In particular embodiments, peptide inhibitors of the present invention are cyclized via a cyclic amide bond, a disulfide bond, or a thioether bond. In particular embodiments, the bond is an intramolecular bond between two amino acid residues within the peptide inhibitor or a monomer subunit thereof.

Peptide Inhibitors

Peptide inhibitors of the present invention include peptides having any of the amino acid sequences described herein, compounds having any of the structures described herein, including compounds comprising any of the peptide sequences described herein, and dimers of any of such peptides and compounds. Peptide inhibitors on the present invention include both peptides not having and those having a bond between X4 and X9, e.g., before and after a cross-link is introduced between X4 and X9. Illustrative peptides of the invention comprise an amino acid sequence or structure described in any of the accompanying tables, Examples and figures.

In certain embodiments, the present invention includes a peptide inhibitor of an interleukin-23 receptor, or a pharmaceutically acceptable salt or solvate thereof, wherein the peptide inhibitor comprises an amino acid sequence of Formula (Xa):

X1-X2-X3-X4-X5-X6-X7-X8-X9-X10-X11-X12-X13-X14-X15-X16-X17-X18-X19-X20 (Xa)

wherein

X1 is any amino acid or absent;
X2 is any amino acid or absent;
X3 is any amino acid or absent;
X4 is any amino acid or chemical moiety capable of forming a bond with X9;
X5 is any amino acid;
X6 is any amino acid;
X7 is any amino acid;
X8 is any amino acid;
X9 is any amino acid or chemical moiety capable of forming a bond with X4;
X10 is any amino acid;
X11 is any amino acid;
X12 is any amino acid;
X13 is any amino acid;
X14 is any amino acid;
X15 is any amino acid,
X16 is any amino acid or absent;
X17 is any amino acid or absent;
X18 is any amino acid or absent;
X19 is any amino acid or absent; and
X20 is any amino acid or absent,
wherein X4 and X9 are capable of forming a bond with each other. In particular embodiments, the bond is a disulfide bond, a thioether bond, a lactam bond, a triazole ring, a selenoether bond, a diselenide bond, or an olefin bond. In certain embodiments, the peptide inhibitor is cyclized via the bond between X4 and X9. In certain embodiments, the peptide inhibitor inhibits the binding of an interleukin-23 (IL-23) to an IL-23 receptor. In particular embodiments, when X4 is not an amino acid, then X1, X2, and X3 are absent.

In one embodiment of the peptide inhibitor of Formula Xa,

X1 is absent;
X2 is absent;
X3 is Glu, D-Glu, Arg, (D)Arg, Phe, (D)Phe, 2-Nal, Thr, Leu, (D)Gln or absent;
X4 is Cys, Abu or Pen;

X5 is Ala, α-MeOrn, α-MeSer, Cit, Dap, Dab, Dap(Ac), Gly, Lys, Asn, N-MeGln, N-MeArg, Orn, Gln, Arg, Ser or Thr;
X6 is Asp or Thr;
X7 is Trp or 6-Chloro-Trp;
X8 is Glu, Gln or Val;
X9 is Cys, Abu or Pen;
X10 is 2-Nal, a Phe analog, Tyr, or a Tyr analog, wherein in particular embodiments, X10 is 2-Nal, Phe(3,4-diF$_2$), Phe (3,4-Cl$_2$), Phe(3-Me), Phe[4-(2-aminoethoxy)], Phe[4-(2-acetylaminoethoxy)], Phe(Br), Phe(4-CONH$_2$), Phe(Cl), Phe(4-CN), Phe(4-guadino), Phe(4-Me), Phe(4-NH$_2$), Phe (4-N$_3$), Tyr, Tyr(Bzl), or Tyr(Me);
X11 is 1-Nal, 2-Nal, Phe(3,4-dimethoxy), 5-HydroxyTrp, Phe(3,4-Cl$_2$), Trp or Tyr(3-tBu);
X12 is 3-Pal, Acpc, Acbc, Acvc, Achc, Agp, Aib, α-DiethylGly, α-MeLys, α-MeLys(Ac), α-MeLeu, α-α-MeOrn, α-MeSer, α-MeVal, Cav, Cha, Cit, Cpa, D-Asn, Glu, His, hLeu, hArg, Lys, Leu, Octgly, Orn, piperidine, Arg, Ser, Thr or THP;
X13 is Cit, Asp, Dab, Dap, Phe, His, Dap(Peg2-Ac), Dap (pyroglutaric acid), Glu, hArg, Lys, Lys(Ac), Lys(Benzoic acid), Lys(glutaric acid), Lys(IVA), Lys(Peg4-isoGlu-Palm), Lys(pyroglutaric acid), Lys-succinic acid, Asn, Orn, Gln, Arg, Thr or Val;
X14 is Asp, Dab(Ac), Dap(Ac), Phe, His, Lys(Ac), Met, Asn(isobutyl), Gln, Arg, Tyr or Asp(1,4-diaminobutane);
X15 is Ala, betaAla, Glu, Gly, Asn, Gln, Arg or Ser,
X16 is any amino acid or absent;
X17 is any amino acid or absent;
X18 is any amino acid or absent;
X19 is any amino acid or absent; and
X20 is any amino acid or absent.

In certain embodiments, X3 is absent. In particular embodiments, X16, X17, X18, X19 and X20 are absent. In particular embodiments, X4 and X9 are Cys, and X4 and X9 are linked via a disulfide bond. In particular embodiments, X4 is Abu and X9 is Pen, and X4 and X9 are linked via a thioether bond. In particular embodiments, X4 is Abu and X9 is Cys, and X4 and X9 are linked via a thioether bond.

In another embodiment of the peptide inhibitor of Formula Xa,
X1 is absent;
X2 is absent;
X3 is Glu, D-Glu, Arg, (D)Arg, Phe, (D)Phe, 2-Nal, Thr, Leu, (D)Gln or absent;
X4 is Cys, Abu or Pen;
X5 is Ala, α-MeOrn, α-MeSer, Cit, Dap, Dab, Dap(Ac), Gly, Lys, Asn, Orn, Gln, Arg, Ser or Thr;
X6 is Asp or Thr;
X7 is Trp or 6-Chloro-Trp;
X8 is Gln or Val;
X9 is Cys, Abu or Pen;
X10 is 2-Nal, a Phe analog, Tyr, or a Tyr analog, wherein in particular embodiments, X10 is 2-Nal, Phe(3,4-diF$_2$), Phe (3-Me), Phe[4-(2-aminoethoxy)], Phe[4-(2-acetylaminoethoxy)], Phe(Br), Phe(4-CONH$_2$), Phe(4-Cl), Phe(4-CN), Phe (4-guadino), Phe(4-Me), Phe(4-NH$_2$), Phe(4-N$_3$), Tyr, Tyr (Bzl), or Tyr(Me);
X11 is 1-Nal, 2-Nal, Phe(3,4-dimethoxy), 5-HydroxyTrp, Phe(3,4-Cl$_2$), Trp or Tyr(3-tBu);
X12 is 3-Pal, Acpc, Acbc, Acvc, Achc, Agp, Aib, α-DiethylGly, α-MeLys, α-MeLys(Ac), α-MeLeu, α-MeOrn, α-MeSer, α-MeVal, Cav, Cha, Cit, Cpa, D-Asn, His, hLeu, hArg, Lys, Leu, Octgly, Orn, 4-amino-4-carboxy-piperidine, or THP;
X13 is Cit, Asp, Dab, Dap, Phe, His, Dap(Peg2-Ac), Dap (pyroglutaric acid), Glu, hArg, Lys, Lys(Ac), Lys(Benzoic acid), Lys(glutaric acid), Lys(IVA), Lys(Peg4-isoGlu-Palm), Lys(pyroglutaric acid), Lys-succinic acid, Asn, Orn, Gln, Arg, Thr or Val;
X14 is Dab(Ac), Dap(Ac), Phe, His, Lys(Ac), Met, Asn, Gln, Arg, or Tyr;
X15 is Ala, βAla, Gly, Asn, Gln, or Ser,
X16 is any amino acid or absent;
X17 is any amino acid or absent;
X18 is any amino acid or absent;
X19 is any amino acid or absent; and
X20 is any amino acid or absent.

In some embodiments, X3 is absent. In particular embodiments, X16, X17, X18, X19 and X20 are absent. In particular embodiments, X4 and X9 are Cys, and X4 and X9 are linked via a disulfide bond. In particular embodiments, X4 is Abu and X9 is Pen, and X4 and X9 are linked via a thioether bond. In particular embodiments, X4 is Abu and X9 is Cys, and X4 and X9 are linked via a thioether bond.

In another embodiment of the peptide inhibitor of Formula Xa,
X1 is absent;
X2 is absent;
X3 is Glu, D-Glu, Arg, (D)Arg, Phe, (D)Phe, 2-Nal, Thr, Leu, (D)Gln or absent;
X4 is Cys, Abu or Pen;
X5 is Dap, Dap(Ac), Gly, Lys, Gln, Arg, Ser, Thr or Asn;
X6 is Thr;
X7 is Trp or 6-Chloro-Trp;
X8 is Gln;
X9 is Cys, Abu or Pen;
X10 is 2-Nal, a Phe analog, Tyr, or a Tyr analog, wherein in particular embodiments, X10 is 2-Nal, Phe(3-Me), Phe[4-(2-aminoethoxy)], Phe[4-(2-acetylaminoethoxy)], Phe(4-CONH$_2$), Phe(4-Me), Phe(4-NH$_2$), Tyr, Tyr(Bzl), or Tyr (Me);
X11 is 1-Nal, 2-Nal, Phe(3,4-dimethoxy), Phe(3,4-Cl$_2$), or Trp;
X12 is Acpc, Acbc, Acvc, Achc, Aib, α-DiethylGly, α-MeLys, α-MeLys(Ac), α-MeLeu, α-MeOrn, α-MeSer, α-MeVal, Cha, Cit, hLeu, Lys, Leu, Arg or THP;
X13 is Cit, Asp, Dap, Dap(Peg2-Ac), Dap(pyroglutaric acid), Glu, hArg, Lys, Lys(Ac), Lys(Benzoic acid), Lys (glutaric acid), Lys(IVA), Lys(Peg4-isoGlu-Palm), Lys(pyroglutaric acid), Lys(succinic acid), Asn, Orn, Gln, Arg, or Val;
X14 is Dab(Ac), Dap(Ac), His, Lys(Ac), Asn, Gln, or Tyr;
X15 is Ala, betaAla, Gly, Asn, Gln, or Ser,
X16 is any amino acid or absent;
X17 is any amino acid or absent;
X18 is any amino acid or absent;
X19 is any amino acid or absent; and
X20 is any amino acid or absent.

In some embodiments, X3 is absent. In particular embodiments, X16, X17, X18, X19 and X20 are absent. In particular embodiments, X4 and X9 are Cys, and X4 and X9 are linked via a disulfide bond. In particular embodiments, X4 is Abu and X9 is Pen, and X4 and X9 are linked via a thioether bond. In particular embodiments, X4 is Abu and X9 is Cys, and X4 and X9 are linked via a thioether bond.

In another embodiment of the peptide inhibitor of Formula Xa,
X1 is absent;
X2 is absent;
X3 is Glu, D-Glu, Arg, (D)Arg, Phe, (D)Phe, 2-Nal, Thr, Leu, (D)Gln or absent;
X4 is Cys, Abu or Pen;
X5 is Dap, Dap(Ac), Gln, Ser, Thr or Asn;

X6 is Thr;
X7 is Trp;
X8 is Gln;
X9 is Cys, Abu or Pen;
X10 is a Phe analog, Tyr, or a Tyr analog, wherein in particular embodiments, X10 is Phe[4-(2-aminoethoxy)], Phe[4-(2-acetylaminoethoxy)], Phe(4-CONH$_2$), Phe(4-Me), Tyr, Tyr(Bzl), or Tyr(Me);
X11 is 2-Nal or Trp;
X12 is Acpc, Acbc, Acvc, Achc, Aib, α-DiethylGly, α-MeLys, α-MeLys(Ac), α-MeLeu, α-MeOrn, α-MeSer, α-MeVal, hLeu, Leu, or THP;
X13 is Cit, Asp, Glu, Lys, Lys(Ac), Asn, or Gln;
X14 is Dab(Ac), Asn, or His;
X15 is Ala, betaAla, Gly, Asn, or Gln;
X16 is any amino acid or absent;
X17 is any amino acid or absent;
X18 is any amino acid or absent;
X19 is any amino acid or absent; and
X20 is any amino acid or absent.

In some embodiments, X3 is absent. In particular embodiments, X16, X17, X18, X19 and X20 are absent. In particular embodiments, X4 and X9 are Cys, and X4 and X9 are linked via a disulfide bond. In particular embodiments, X4 is Abu and X9 is Pen, and X4 and X9 are linked via a thioether bond. In particular embodiments, X4 is Abu and X9 is Cys, and X4 and X9 are linked via a thioether bond.

In particular embodiments, the peptide inhibitor comprises the amino acid sequence set forth in any of the various formula described herein, e.g., Ia-It, IIa-IId, IIIa-IIIe, or IV.

In certain embodiments, the present invention includes a peptide inhibitor of an interleukin-23 receptor, wherein the peptide inhibitor has the structure of Formula I:

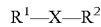 (I)

or a pharmaceutically acceptable salt or solvate thereof,
wherein R$^1$ is a bond, hydrogen, an C1-C6 alkyl, a C6-C12 aryl, a C6-C12 aryl C1-C6 alkyl, a C1-C20 alkanoyl, and including PEGylated versions alone or as spacers of any of the foregoing;
R$^2$ is a bond, OH or NH$_2$; and
X is an amino acid sequence, e.g., an amino acid comprising 7 to 35 amino acid residues. In certain embodiments, R$^2$ is OH or NH$_2$.

In certain embodiments, X comprises a sequence of Formula Xa.

In particular embodiments of formula (I), X comprises the sequence of Formula Ia:

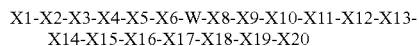 (Ia)

wherein
X1 is any amino acid or absent;
X2 is any amino acid or absent;
X3 is any amino acid or absent;
X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys, Sec, 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid, Abu, β-azido-Ala-OH, propargylglycine, 2-(3'-butenyl)glycine, 2-allylglycine, 2-(3'-butenyl)glycine, 2-(4'-pentenyl)glycine, 2-(5'-hexenyl)glycine or absent;
X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, CitDap, Dab, Dap (Ac), Gly, Lys, Asn, N-Me-Gln, N-Me-Arg, Orn or Gln, X6 is Asp, Thr, Asn, Phe, D-Asp, D-Thr, D-Asn, or D-Phe;
X8 is Val, Gln, Glu, or Lys;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, Ser, Sec, Abu, β-azido-Ala-OH, propargylglycine, 2-2-allylglycine, 2-(3'-butenyl)glycine, 2-(4'-pentenyl)glycine, or 2-(5'-hexenyl)glycine;
X10 is Tyr, Phe, Phe(3,4-F$_2$), Phe(3,4-Cl$_2$), F(3-Me), Phe[4-(2-aminoethoxy)], Phe[4-(2-(acetyl-aminoethoxy)], Phe (4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;
X11 is Trp, 1-Nal, 2-Nal, Phe(3,4-OMe$_2$) 5-Hydroxy-Trp, Phe(3,4-Cl$_2$) or Tyr(3-t-Bu)
X12 is His, Phe, Arg, N-Me-His, or Val, Cav, Cpa, Leu, Cit, hLeu, 3-Pal, t-butyl-Ala, t-butyl-Gly 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;
X14 is Phe, Tyr βhPhe, Asn, Arg, Gln, Lys(Ac), His; Dap(Ac), Dab(Ac), or Asp;
X15 is Gly, Ser, Thr, Gln, Ala, Sarc, β-Ala, Glu, Arg or Asn;
X16 is any amino acid or absent;
X17 is any amino acid or absent;
X18 is any amino acid or absent;
X19 is any amino acid or absent; and
X20 is any amino acid or absent.

In particular embodiments of Ia: X5 is Ala, Arg, Glu, Phe, Leu, Thr, Ser, Aib, Sarc, D-Ala, D-Arg, D-Glu, D-Phe, D-Leu, D-Thr, D-Ser, D-Aib or D-Sarc; X10 is Tyr or Phe; X11 is Trp, 1-Nal or 2-Nal; X12 is His, Phe, Arg, N-Me-His, or Val, Cav, Cpa, Leu, Cit, hLeu, 3-Pal, t-butyl-Ala or t-butyl-Gly; X13 is Thr, Sarc, Glu, Phe, Arg, Leu, Lys, Val, βhAla, or Aib; X14 is Phe, Tyr or βhPhe; X15 is Gly, Ser, Thr, Gln, Ala or Sarc; X16 is Asp, Glu, Ala, AEA, AEP, βhAla, Gaba, or absent; and X17 is Leu, Lys, Arg, or absent.

In particular embodiments, X4 is present.
In certain embodiments, the peptide inhibitor is cyclized.
In certain embodiments, the peptide inhibitor is linear or not cyclized.
In certain embodiments, the peptide inhibitor is cyclized, or contains an intramolecular bond, between X4 and X9.
In certain embodiments of Formula I, X comprises the sequence of Formula Ib:

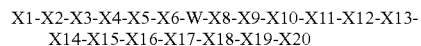 (Ib), wherein:
X1 is any amino acid or absent;
X2 is any amino acid or absent;
X3 is any amino acid or absent;
X4 is Cys, Pen, hCys, D-Pen, D-Cys, D-hCys, Glu, Asp, Lys, Orn, Dap, Dab, D-Dap, D-Dab, D-Asp, D-Glu, D-Lys, Sec, 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid, Abu, β-azido-Ala-OH, propargylglycine, 2-(3'-butenyl)glycine, 2-2-allylglycine, 2-(3'-butenyl)glycine, 2-(4'-pentenyl)glycine, 2-(5'-hexenyl)glycine, or absent;
X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, CitDap, Dab, Dap (Ac), Gly, Lys, Asn, N-Me-Gln, N-Me-Arg, Orn or Gln;

X6 is Asp, Thr, Asn, Phe, D-Asp, D-Thr, D-Asn, or D-Phe;
X8 is Val, Gln, Glu, or Lys;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Sec, Abu, β-azido-Ala-OH, propargylglycine, 2-allylglycine, 2-(3'-butenyl)glycine, 2-(4'-pentenyl)glycine, or 2-(5'-hexenyl)glycine;
X10 is Tyr, Phe, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr
X11 is Trp, 1-Nal, 2-Nal, Phe(3,4-OMe$_2$) 5-Hydroxy-Trp, Phe(3,4-Cl$_2$), Tyr(3-t-Bu)
X12 is His, Phe, Arg, N-Me-His, Val, Cav, Cpa, Leu, Cit, hLeu, 3-Pal, t-butyl-Ala, t-butyl-Gly4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys
X13 is Thr, Sarc, Glu, Phe, Arg, Leu, Lys, Val, βhAlaAib, Lys(Ac), Cit, Asp, Dab, Dap, Glu, hArg, Lys, Asn, Orn, or Gln
X14 is Phe, Tyr, or βhPhe, Asn, Arg, Gln, Lys(Ac), His; Dap(Ac), Dab(Ac) or Asp;
X15 is Gly, Ser, Thr, Gln, Ala, or Sarc, β-Ala, Glu, Arg or Asn;
X16 is any amino acid or absent;
X17 is any amino acid, or absent;
X18 is any amino acid or absent;
X19 is any amino acid or absent; and
X20 is any amino acid or absent.

In particular embodiments of Ib: X5 is Ala, Arg, Glu, Phe, Leu, Thr, Ser, Aib, Sarc, D-Ala, D-Arg, D-Glu, D-Phe, D-Leu, D-Thr, D-Ser, D-Aib or D-Sarc; X10 is Tyr or Phe; X11 is Trp, 1-Nal or 2-Nal; X12 is His, Phe, Arg, N-Me-His, Val, Cav, Cpa, Leu, Cit, hLeu, 3-Pal, t-butyl-Ala or t-butyl-Gly; X13 is Thr, Sarc, Glu, Phe, Arg, Leu, Lys, Val, βhAla or Aib; X14 is Phe, Tyr or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In particular embodiments, X4 is present.
In certain embodiments, the peptide inhibitor is cyclized.
In certain embodiments, the peptide inhibitor is linear or not cyclized.
In certain embodiments, the peptide inhibitor is cyclized, or contains an intramolecular bond, between X4 and X9.
In certain embodiments of Formula I, X comprises the sequence of Formula Ic:

X1-X2-X3-X4-X5-X6-W-X8-X9-Y-X11-X12-X13-X14-X15-X16-X17-X18-X19-X20 (Ic)

wherein
X1 is any amino acid or absent;
X2 is any amino acid or absent;
X3 is any amino acid or absent;
X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys, Sec, 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid, Abu, β-azido-Ala-OH, propargylglycine, 2-allylglycine, 2-(3'-butenyl)glycine, 2-(4'-pentenyl)glycine, 2-(5'-hexenyl)glycine, or absent;
X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, CitDap, Dab, Dap (Ac), Gly, Lys, Asn, N-Me-Gln, N-Me-Arg, Orn or Gln
X6 is Asp, Thr, Asn, Phe, D-Asp, D-Thr, D-Asn, or D-Phe;
X8 is Val, Gln, Glu, or Lys;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Sec, Abu, β-azido-Ala-OH, propargylglycine, 2-allylglycine, 2-(3'-butenyl)glycine, 2-(4'-pentenyl)glycine, or 2-(5'-hexenyl)glycine;
X11 is Trp, 1-Nal, 2-Nal Phe(3,4-OMe$_2$) 5-Hydroxy-Trp, Phe(3,4-Cl$_2$) or Tyr(3-t-Bu)
X12 is His, Phe, Arg, N-Me-His, Val, Cav, Cpa, Leu, Cit, hLeu, 3-Pal, t-butyl-Ala t-butyl-Gly; 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys
X13 is Thr, Sarc, Glu, Phe, Arg, Leu, Lys, Val, βhAla, or Aib, Lys(Ac), Cit, Asp, Dab, Dap, Glu, hArg, Lys, Asn, Orn, or Gln
X14 is Phe, Tyr, βhPhe, Asn, Arg, Gln, Lys(Ac), His; Dap(Ac), Dab(Ac) or Asp;
X15 is Gly, Ser, Thr, Gln, Ala, Sarc, β-Ala, Glu, Arg or Asn;
X16 is any amino acid or absent;
X17 is any amino acid or absent;
X18 is any amino acid or absent;
X19 is any amino acid or absent; and
X20 is any amino acid or absent.

In particular embodiments of Ic, X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X11 is Trp, 1-Nal, or 2-Nal; X12 is His, Phe, Arg, N-Me-His, Val, Cav, Cpa, Leu, Cit, hLeu, 3-Pal, t-butyl-Ala or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In particular embodiments, X4 is present.
In certain embodiments, the peptide inhibitor is cyclized.
In certain embodiments, the peptide inhibitor is linear or not cyclized.
In certain embodiments, the peptide inhibitor is cyclized, or contains an intramolecular bond, between X4 and X9.
In certain embodiments of Formula I, X comprises the sequence of Formula Id:

X1-X2-X3-C-X5-X6-W-X8-C-X10-X11-X12-X13-X14-X15-X16-X17-X18-X19-X20 (Id)

wherein
X1 is any amino acid or absent;
X2 is any amino acid or absent;
X3 is any amino acid or absent;
X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, CitDap, Dab, Dap (Ac), Gly, Lys, Asn, N-Me-Gln, N-Me-Arg, Orn or Gln;
X6 is Asp, Thr, Asn, Phe, D-Asp, D-Thr, D-Asn, or D-Phe;
X8 is Val, Gln, Glu, or Lys;
X10 is Tyr Phe, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr
X11 is Trp, 1-Nal, 2-Nal, Phe(3,4-OMe$_2$) 5-Hydroxy-Trp, Phe(3,4-Cl$_2$), Tyr(3-t-Bu)

X12 is His, Phe, Arg, N-Me-His, Val, Cav, Cpa, Leu, Cit, hLeu, 3-Pal, t-butyl-Ala, t-butyl-Gly, 4-amino-4-carboxytetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln X14 is Phe, Tyr, βhPhe, Asn, Arg, Gln, Lys(Ac), His, Dap(Ac), Dab(Ac) or Asp;

X15 is Gly, Ser, Thr, Gln, Ala, Sarc, β-Ala, Glu, Arg or Asn;

X16 is any amino acid or absent;

X17 is any amino acid or absent;

X18 is any amino acid or absent;

X19 is any amino acid or absent; and

X20 is any amino acid or absent, wherein X4 and X9 are optionally linked by a intramolecular disulphide bridge.

In certain embodiments of Id: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X10 is Tyr or Phe; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In certain embodiments of Formula I, X comprises the sequence of Formula Ie:

X1-X2-X3-X4-X5-X6-W-X8-X9-X10-X11-X12-X13-X14-X15-X16-X17-X18-X19-X20    (Ie)

wherein

X1 is any amino acid or absent;

X2 is any amino acid or absent;

X3 is any amino acid or absent;

X4 is Pen, hCys, D-Pen, or D-hCys;

X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, CitDap, Dab, Dap (Ac), Gly, Lys, Asn, N-Me-Gln, N-Me-Arg, Orn or Gln;

X6 is Asp, Thr, Asn, Phe, D-Asp, D-Thr, D-Asn, or D-Phe;

X8 is Val, Gln, Glu, or Lys;

X9 is Pen, hCys, D-Pen, D-Cys, D-hCys;

X10 is Tyr, Phe Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;

X11 is Trp, 1-Nal, 2-Nal, Phe(3,4-OMe$_2$) 5-Hydroxy-Trp, Phe(3,4-Cl$_2$) or Tyr(3-t-Bu);

X12 is His, Phe, Arg, N-Me-His, Val, Cav, Cpa, Leu, Cit, hLeu, 3-Pal, t-butyl-Ala, t-butyl-Gly, 4-amino-4-carboxytetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;

X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;

X14 is Phe, Tyr, βhPhe, Asn, Arg, Gln, Lys(Ac), His; Dap(Ac), Dab(Ac) or Asp;

X15 is Gly, Ser, Thr, Gln, Ala, Sarc, β-Ala, Glu, Arg or Asn;

X16 is any amino acid or absent;

X17 is any amino acid or absent;

X18 is any amino acid or absent;

X19 is any amino acid or absent; and

X20 is any amino acid or absent, wherein X4 and X9 are optionally linked by a intramolecular disulphide bridge.

In certain embodiments of Ie: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X10 is Tyr or Phe; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In particular embodiments, X4 is present.

In certain embodiments, the peptide inhibitor is cyclized.

In certain embodiments, the peptide inhibitor is linear or not cyclized.

In certain embodiments, the peptide inhibitor is cyclized, or contains an intramolecular bond, between X4 and X9.

In particular embodiments, X4 and X9 and both Pen.

In certain embodiments of Formula I, X comprises the sequence of Formula If:

X1-X2-X3-X4-X5-X6-W-X8-X9-X10-X11-X12-X13-X14-X15-X16-X17-X18-X19-X20    (If)

wherein

X1 is any amino acid or absent;

X2 is any amino acid or absent;

X3 is any amino acid or absent;

X4 is Glu, Lys, Orn, Dap, Dab, D-Dap, D-Dab, D-Asp, D-Glu, D-Lys, or Asp;

X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, Cit, Dap, Dab, Dap (Ac), Gly, Lys, Asn, N-Me-Gln, N-Me-Arg, Orn or Gln;

X6 is Asp, Thr, Asn, Phe, D-Asp, D-Thr, D-Asn, or D-Phe;

X8 is Val, Gln, Glu, or Lys;

X9 is Glu, Lys, Orn, Dap, Dab, D-Dap, D-Dab, D-Asp, D-Glu, D-Lys, or Asp;

X10 is Tyr, Phe, Phe(3,4-Cl2), Phe(3,4-C12), F(3-Me), Phe[4-(2-aminoethoxy)], Phe[4-(2-(acetyl-aminoethoxy)], Phe(4-Br), Phe(4-CONH2), Phe(4-Cl), Phe(4-CN), Phe(4-guanidino), Phe(4-Me), Phe(4-NH2), Phe(4-N$_3$), Phe(4-OMe), Phe(4-OBzl) or Tyr;

X11 is Trp, 1-Nal, 2-Nal, Phe(3,4-OMe$_2$) 5-Hydroxy-Trp, Phe(3,4-Cl$_2$) or Tyr(3-t-Bu);

X12 is His, Phe, Arg, N-Me-His, Val, Cav, Cpa, Leu, Cit, hLeu, 3-Pal, t-butyl-Ala, or t-butyl-Gly, 4-amino-4-carboxytetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;

X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;

X14 is Phe, Tyr, βhPhe, Asn, Arg, Gln, Lys(Ac), His; Dap(Ac), Dab(Ac) or Asp;

X15 is Gly, Ser, Thr, Gln, Ala, Sarc, β-Ala, Glu, Arg or Asn;

X16 is any amino acid or absent;

X17 is any amino acid or absent;

X18 is any amino acid or absent;

X19 is any amino acid or absent; and

X20 is any amino acid or absent, wherein X4 and X9 are optionally cyclized through an intramolecular bond.

In certain embodiments of If: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X6 is Asp, Thr, Asn, Phe, D-Asp, D-Thr, D-Asn, or D-Phe; X8 is Val, Gln, Glu, or Lys; X9 is Glu, Lys, Orn, Dap, Dab, D-Dap, D-Dab, D-Asp, D-Glu, D-Lys, or Asp; X10 is Tyr or Phe; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In certain embodiments, the intramolecular bond is a lactam bond.

In certain embodiments of Formula I, X comprises the sequence of Formula Ig:

X1-X2-X3-X4-X5-X6-W-X8-X9-X10-X11-X12-X13-X14-X15-X16-X17-X18-X19-X20 (Ig)

wherein
X1 is any amino acid or absent;
X2 is any amino acid or absent;
X3 is any amino acid or absent;
X4 is β-azido-Ala-OH, or propargylglycine;
X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, Cit, Dap, Dab, Dap(Ac), Gly, Lys, Asn, N-MeGln, N-MeArg, Orn or Gln;
X6 is Asp, Thr, Asn, Phe, D-Asp, D-Thr, D-Asn, or D-Phe;
X8 is Val, Gln, Glu, or Lys;
X9 is β-azido-Ala-OH or propargylglycine;
X10 is Tyr, Phe, Phe(3,4-F₂), Phe(3,4-Cl₂), F(3-Me), Phe[4-(2-aminoethoxy)], Phe[4-(2-(acetyl-aminoethoxy)], Phe(4-Br), Phe(4-CONH₂), Phe(4-Cl), Phe(4-CN), Phe(4-guanidino), Phe(4-Me), Phe(4-NH₂), Phe(4-N₃), Phe(4-OMe), Phe(4-OBzl) or Tyr;
X11 is Trp, 1-Nal, 2-Nal, Phe(3,4-OMe₂) 5-Hydroxy-Trp, Phe(3,4-Cl₂) or Tyr(3-t-Bu)
X12 is His, Phe, Arg, N-Me-His, Val, Cav, Cpa, Leu, Cit, hLeu, 3-Pal, t-butyl-Ala, or t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;
X14 is Phe, Tyr, βhPhe, Asn, Arg, Gln, Lys(Ac), His; Dap(Ac), Dab(Ac) or Asp;
X15 is Gly, Ser, Thr, Gln, Ala, or Sarc; β-Ala, Glu, Arg or Asn;
X16 is any amino acid or absent;
X17 is any amino acid or absent;
X18 is any amino acid or absent;
X19 is any amino acid or absent; and
X20 is any amino acid or absent,
wherein X4 and X9 are optionally cyclized through an intramolecular triazole ring.

In particular embodiments of Ig: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X6 is Asp, Thr, Asn, Phe, D-Asp, D-Thr, D-Asn, or D-Phe; X8 is Val, Gln, Glu, or Lys; X9 is β-azido-Ala-OH or propargylglycine; X10 is Tyr or Phe; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In certain embodiments of Formula I, X comprises the sequence of Formula Ih:

X1-X2-X3-X4-X5-X6-W-X8-X9-Y-X11-H-X13-F-X15-X16-X17-X18-X19-X20 (SEQ ID NO: 1111) (Ih)

wherein
X1 is any amino acid or absent;
X2 is any amino acid or absent;
X3 is any amino acid or absent;
X4 is 2-allylglycine, 2-(3'-butenyl)glycine, 2-(4'-pentenyl)glycine, or 2-(5'-hexenyl)glycine;
X5 is Ala, Arg, Sarc, α-MeOrn, α-MeSer, Cit, Dap, Dab, Dap(Ac), Gly, Lys, Asn, N-MeGln, N-MeArg, Orn or Gln;
X6 is Asp, Thr, or Asn;
X8 is Val, Gln, or Glu;
X9 is 2-allylglycine, 2-(3'-butenyl)glycine, 2-(4'-pentenyl)glycine, or 2-(5'-hexenyl)glycine;
X11 is Trp, 1-Nal, 2-Nal, Phe(3,4-OMe₂) 5-Hydroxy-Trp, Phe(3,4-Cl₂) or Tyr(3-t-Bu)
X13 is Thr, Sarc, Glu, Phe, Arg, Leu, Lys, βhAla, Val, Aib, Lys(Ac), Cit, Asp, Dab, Dap, Glu, hArg, Lys, Asn, Orn, or Gln;
X15 is Gly, Ser, Thr, Gln, Ala, Sarc, β-Ala, Glu, Arg or Asn;
X16 is any amino acid or absent;
X17 is any amino acid or absent;
X18 is any amino acid or absent;
X19 is any amino acid or absent; and
X20 is any amino acid or absent,
wherein X4 and X9 are optionally cyclized via an intramolecular ring closing methasis to give the corresponding olefins.

In particular embodiments of Ih: X5 is Ala, Arg, or Sarc; X6 is Asp, Thr, or Asn; X11 is Trp, 1-Nal, or 2-Nal; X13 is Thr, Sarc, Glu, Phe, Arg, Leu, Lys, βhAla, Val, or Aib; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In certain embodiments of Formula I, X comprises the sequence of Formula Ii:

X1-X2-X3-X4-X5-X6-W-X8-X9-X10-X11-X12-X13-X14-X15-X16-X17-X18-X19-X20 (Ii), wherein:
X1 is any amino acid or absent;
X2 is any amino acid or absent;
X3 is any amino acid or absent;
X4 is Cys, Pen, hCys, D-Pen, D-Cys, D-hCys, 2-chloromethylbenzoic acid, mercapto-propanoic acid, mercapto-butyric acid, 2-chloro-acetic acid, 3-chloro-propanoic acid, 4-chloro-butyric acid, or 3-chloro-isobutyric acid;
X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc, α-MeOrn, α-MeSer, Cit, Dap, Dab, Dap(Ac), Gly, Lys, Asn, N-MeGln, N-MeArg, Orn or Gln;
X6 is Asp, Thr, Asn, Phe, D-Asp, D-Thr, D-Asn, or D-Phe;
X8 is Val, Gln, Glu, or Lys;
X9 is Cys, Pen, hCys, D-Pen, D-Cys, D-hCys, or Abu;
X10 is Tyr, Phe, Phe(3,4-F₂), Phe(3,4-Cl₂), F(3-Me), Phe[4-(2-aminoethoxy)], Phe[4-(2-(acetyl-aminoethoxy)], Phe(4-Br), Phe(4-CONH₂), Phe(4-Cl), Phe(4-CN), Phe(4-guanidino), Phe(4-Me), Phe(4-NH₂), Phe(4-N₃), Phe(4-OMe), Phe(4-OBzl) or Tyr;
X11 is Trp, 1-Nal, 2-Nal, Phe(3,4-OMe₂) 5-Hydroxy-Trp, Phe(3,4-Cl₂) or Tyr(3-t-Bu)

X12 is His, Phe, Arg, N-Me-His, Val, Cav, Cpa, Leu, Cit, hLeu, 3-Pal, t-butyl-Ala, t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;

X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;

X14 is Phe, Tyr, βhPhe, Asn, Arg, Gln, Lys(Ac), His; Dap(Ac), Dab(Ac) or Asp;

X15 is Gly, Ser, Thr, Gln, Ala, Sarc, β-Ala, Glu, Arg or Asn;

X16 is any amino acid or absent;

X17 is any amino acid or absent;

X18 is any amino acid or absent;

X19 is any amino acid or absent; and

X20 is any amino acid or absent, wherein X4 and X9 are optionally cyclized via an intramolecular thioether bond.

In particular embodiments of Ii: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X6 is Asp, Thr, Asn, Phe, D-Asp, D-Thr, D-Asn, or D-Phe; X10 is Tyr or Phe; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In certain embodiments of Formula I, X comprises the sequence of Formula Ij:

X1-X2-X3-X4-X5-X6-W-X8-X9-X10-X11-X12-X13-
X14-X15-X16-X17-X18-X19-X20  (Ij), wherein:

X1 is any amino acid or absent;

X2 is any amino acid or absent;

X3 is any amino acid or absent;

X4 is Sec, 2-chloromethylbenzoic acid, 3-chloro-propanoic acid, 4-chloro-butyric acid, 3-chloro-isobutyric acid, or Abu;

X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, Cit, Dap, Dab, Dap(Ac), Gly, Lys, Asn, N-MeGln, N-MeArg, Orn or Gln;

X6 is Asp, Thr, Asn, Phe, D-Asp, D-Thr, D-Asn, or D-Phe;

X8 is Val, Gln, Glu, or Lys;

X9 is Sec or Abu;

X10 is Tyr, Phe, Phe(3,4-F$_2$), Phe(3,4-Cl$_2$), F(3-Me), Phe[4-(2-aminoethoxy)], Phe[4-(2-aminoethoxy), Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;

X11 is Trp, 1-Nal, 2-Nal, Phe(3,4-OMe$_2$) 5-Hydroxy-Trp, Phe(3,4-Cl$_2$) or Tyr(3-t-Bu);

X12 is His, Phe, Arg, N-Me-His, Val, Cav, Cpa, Leu, Cit, hLeu, 3-Pal, t-butyl-Ala, t-butyl-Gly, 4-amino-4-carboxy-tetrahydropyran, Achc, Acpc, Acbc, Agp, Aib, α-Diethyl-Gly, α-MeLys, α-MeLys(Ac), α-Me-Leu, α-MeOrn, α-MeSer, α-MeVal, Cha, Cit, Cpa, (D)Asn, Glu, hArg, or Lys;

X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;

X14 is Phe, Tyr, βhPhe, Asn, Arg, Gln, Lys(Ac), His; Dap(Ac), Dab(Ac) or Asp;

X15 is Gly, Ser, Thr, Gln, Ala, Sarc, β-Ala, Glu, Arg or Asn;

X16 is any amino acid or absent;

X17 is any amino acid or absent;

X18 is any amino acid or absent;

X19 is any amino acid or absent; and

X20 is any amino acid or absent, wherein X4 and X9 are optionally cyclized via an intramolecular thioseleno or diselenide bond.

In particular embodiments of Ij: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X10 is Tyr or Phe; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, or Aib; X14 is Phe, Tyr, or βhPhe; X15 is Gly, Ser, Thr, Gln, Ala, or Sarc; X16 is Asp, Glu, Ala, AEA, AEP, βhAla, Gaba, or absent; and X17 is Leu, Lys, Arg, or absent.

In certain embodiments of Formula I, X comprises the sequence of Formula Ik:

X1-X2-X3-X4-X5-X6-W-X8-X9-X10-X11-X12-X13-
X14-X15-X16-X17-X18-X19-X20  (Ik), wherein X1 is any amino acid or absent;

X2 is any amino acid or absent;

X3 is any amino acid or absent;

X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys or absent;

X5 is Ala, Arg, Glu, Phe, Leu, Thr, Ser, Aib, Sarc, D-Ala, D-Arg, D-Glu, D-Phe, D-Leu, D-Thr, D-Ser, α-MeOrn, α-MeSer, Cit, Dap, Dab, Dap(Ac), Gly, Lys, Asn, N-MeGln, N-MeArg, Orn or Gln;

X6 is Asp, Thr, Asn, Phe, D-Asp, D-Thr, D-Asn, or D-Phe;

X8 is Val, Gln, Glu, or Lys;

X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, or Ser;

X10 is Tyr, Phe, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;

X11 is Trp, 1-Nal, 2-Nal, Phe(3,4-OMe$_2$) 5-Hydroxy-Trp, Phe(3,4-Cl$_2$) or Tyr(3-t-Bu);

X12 is His, Phe, Arg, N-Me-His, Val, D-His, Cav, Cpa, Leu, Cit, hLeu, 3-Pal, t-butyl-Ala, t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;

X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln;

X14 is Phe, Tyr, βhPhe, Asn, Arg, Gln, Lys(Ac), His; Dap(Ac), Dab(Ac) or Asp or absent;

X15 is Gly, Ser, Thr, Gln, Ala, Sarc, β-Ala, Glu, Arg or Asn or absent;

X16 is any amino acid or absent;

X17 is any amino acid or absent;

X18 is any amino acid or absent;

X19 is any amino acid or absent; and

X20 is any amino acid or absent.

In particular embodiments of Ik: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X10 is Tyr or Phe; X11 is Trp, 1-Nal, or 2-Nal; X12 is His, Phe, Arg, N-Me-His, Val, D-His, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, Aib or absent; X14 is Phe, Tyr, βhPhe or absent; X15 is Gly, Ser, Thr, Gln, Ala, Sarc or absent; X16 is Asp, Glu, Ala, AEA, AEP, βhAla, Gaba, Leu, or absent; and X17 is Leu, Lys, Arg, or absent.

In certain embodiments of Formula I, X comprises or consists of the sequence of Formula Il:

X1-X2-X3-X4-X5-X6-W-X8-X9-X10-X11-X12-X13-X14-X15-X16-X17-X18-X19-X20 (Il), wherein
X1 is any amino acid or absent;
X2 is any amino acid or absent;
X3 is any amino acid or absent;
X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys or absent;
X5 is Ala, Arg, Glu, Phe, Leu, Thr, Ser, Aib, Sarc, α-MeOrn, α-MeSer, Cit, Dap, Dab, Dap(Ac), Gly, Lys, Asn, N-MeGln, N-MeArg, Orn or Gln;
X6 is Asp, Thr, Asn, or Phe;
X8 is Val, Gln, Glu, or Lys;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, or Ser;
X10 is Tyr, Phe, Phe(3,4-$F_2$), Phe(3,4-$Cl_2$), F(3-Me), Phe[4-(2-aminoethoxy)], Phe[4-(2-(acetyl-aminoethoxy)], Phe(4-Br), Phe(4-$CONH_2$), Phe(4-Cl), Phe(4-CN), Phe(4-guanidino), Phe(4-Me), Phe(4-$NH_2$), Phe(4-$N_3$), Phe(4-OMe), Phe(4-OBzl) or Tyr;
X11 is Trp, 1-Nal, 2-Nal, Phe(3,4-$OMe_2$) 5-Hydroxy-Trp, Phe(3,4-$Cl_2$) or Tyr(3-t-Bu);
X12 is His, Phe, Arg, N-Me-His, Val, D-His, Cav, Cpa, Leu, Cit, hLeu, 3-Pal, t-butyl-Ala, t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Thr, Sarc, Glu, Phe, Arg, Leu, Lys, Val, βhAla, Aib, Lys(Ac), Cit, Asp, Dab, Dap, Glu, hArg, Lys, Asn, Orn, or Gln or absent;
X14 is Phe, Tyr, βhPhe, Asn, Arg, Gln, Lys(Ac), His; Dap(Ac), Dab(Ac) or Asp or absent;
X15 is Gly, Ser, Thr, Gln, Ala, Sarc, β-Ala, Glu, Arg or Asn or absent;
X16 is any amino acid or absent;
X17 is any amino acid or absent;
X18 is any amino acid or absent;
X19 is any amino acid or absent; and
X20 is any amino acid or absent.

In particular embodiments of Il: X5 is Ala, Arg, Glu, Phe, Leu, Thr, Ser, Aib, or Sarc;
X10 is Tyr or Phe; X11 is Trp, 1-Nal, or 2-Nal; X12 is His, Phe, Arg, N-Me-His, Val, D-His, Cav, Cpa, Leu, Cit, hLeu, 3-Pal, t-butyl-Ala, or t-butyl-Gly; X13 is Thr, Sarc, Glu, Phe, Arg, Leu, Lys, Val, βhAla, Aib or absent; X14 is Phe, Tyr, βhPhe or absent; X15 is Gly, Ser, Thr, Gln, Ala, Sarc or absent; X16 is Asp, Glu, Ala, AEA, AEP, βhAla, Gaba, Leu, or absent; and
X17 is Leu, Lys, Arg, or absent.

In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln. In certain embodiments, X13 is Thr, Sarc, Glu, Phe, Arg, Leu, Lys, βhAla, or Aib.

In certain embodiments, X14 is Phe, Tyr, βhPhe, Asn, Arg, Gln, Lys(Ac), His; Dap(Ac), Dab(Ac) or Asp. In certain embodiments, X14 is Phe, Tyr, or βhPhe.

In certain embodiments, X15 is Gly, Ser, Thr, Gln, Ala, Sarc, β-Ala, Glu, Arg or Asn. In certain embodiments, X15 is Gly, Ser, Thr, Gln, Ala, or Sarc.

In certain embodiments, X12 is alpha amino acid, e.g., 4-amino-4-carboxy-tetrahydropyran, Achc Acpc, Acbc, Aib, α-MeGly(diethyl), α-MeLys, α-MeLys(Ac), α-Me-Leu, α-MeOrn, α-MeSer, α-MeVal.

In certain embodiments, X13 is present.
In certain embodiments, X13 and X14 are present.
In certain embodiments, X13, X14 and X15 are present.
In particular embodiments, X4 is present.
In certain embodiments, the peptide inhibitor is cyclized.
In certain embodiments, the peptide inhibitor is linear or not cyclized.
In certain embodiments, the peptide inhibitor is cyclized, or contains an intramolecular bond, between X4 and X9.
In certain embodiments of the peptide inhibitor of Formula I, X comprises or consists of the sequence of Formula Im:

X1-X2-X3-X4-X5-X6-W-X8-X9-Y-X11-X12-X13-X14-X15-X16-X17-X18-X19-X20 (Im), wherein
X1 is any amino acid or absent;
X2 is any amino acid or absent;
X3 is any amino acid or absent;
X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys or absent;
X5 is Ala, Arg, Glu, Phe, Leu, Thr, Ser, Aib, Sarc, α-MeOrn, α-MeSer, Cit, Dap, Dab, Dap(Ac), Gly, Lys, Asn, N-MeGln, N-MeArg, Orn, or Gln;
X6 is Asp, Thr, Asn, or Phe;
X8 is Val, Gln, Glu, or Lys;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, or Ser;
X11 is Trp, 1-Nal, 2-Nal, Phe(3,4-$OMe_2$); 5-Hydroxy-Trp, Phe(3,4-$Cl_2$), or Tyr(3-t-Bu);
X12 is His, Phe, Arg, N-Me-His, Val, Cav, Cpa, Leu, Cit, hLeu, 3-Pal, t-butyl-Ala, or t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Thr, Sarc, Glu, Phe, Arg, Leu, Lys, βhAla, Val, Aib, Lys(Ac), Cit, Asp, Dab, Dap, Glu, hArg, Lys, Asn, Orn, or Gln or absent;
X14 is Phe, Tyr, βhPhe, Asn, Arg, Gln, Lys(Ac), His; Dap(Ac), Dab(Ac), or Asp or absent;
X15 is Gly, Ser, Thr, Gln, Ala, Sarc, β-Ala, Glu, Arg or Asn or absent;
X16 is any amino acid or absent;
X17 is any amino acid or absent;
X18 is any amino acid or absent;
X19 is any amino acid or absent; and
X20 is any amino acid or absent.

In certain embodiments of Im: X5 is Ala, Arg, Glu, Phe, Leu, Thr, Ser, Aib, or Sarc; X11 is Trp, 1-Nal, or 2-Nal; X12 is His, Phe, Arg, N-Me-His, Val, Cav, Cpa, Leu, Cit, hLeu, 3-Pal, t-butyl-Ala, or t-butyl-Gly; X13 is Thr, Sarc, Glu, Phe, Arg, Leu, Lys, βhAla, Val, Aib or absent; X14 is Phe, Tyr, βhPhe or absent; X15 is Gly, Ser, Thr, Gln, Ala, Sarc or absent; X16 is Asp, Glu, Ala, AEA, AEP, βhAla, Gaba, or absent; and X17 is Leu, Lys, Arg, or absent.

In certain embodiments, X13 is Thr, Sarc, Glu, Phe, Arg, Leu, Lys, βhAla, or Aib. In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln.

In certain embodiments, X14 is Phe, Tyr, βhPhe, Asn, Arg, Gln, Lys(Ac), His; Dap(Ac), Dab(Ac) or Asp. In certain embodiments, X14 is Phe, Tyr, or βhPhe.

In certain embodiments, X15 is Gly, Ser, Thr, Gln, Ala, or Sarc, β-Ala, Glu, Arg or Asn. In certain embodiments, X15 is Gly, Ser, Thr, Gln, Ala, or Sarc.

In certain embodiments, X12 is alpha amino acid, e.g., 4-amino-4-carboxy-tetrahydropyran, Achc Acpc, Acbc, Aib, α-MeGly(diethyl), α-MeLys, α-MeLys(Ac), α-Me-Leu, α-MeOrn, α-MeSer, α-MeVal.

In certain embodiments, X13 is present.

In certain embodiments, X13 and X14 are present.

In certain embodiments, X13, X14, and X15 are present.

In particular embodiments, X4 is present.

In certain embodiments, the peptide inhibitor is cyclized.

In certain embodiments, the peptide inhibitor is linear or not cyclized.

In certain embodiments, the peptide inhibitor is cyclized, or contains an intramolecular bond, between X4 and X9.

In certain embodiments of the peptide inhibitor of Formula I, X comprises or consists of the sequence of Formula In:

X1-X2-X3-C-X5-X6-W-X8-C-X10-X11-X12-X13-X14-X15-X16-X17-X18-X19-X20  (In)

wherein

X1 is any amino acid or absent;
X2 is any amino acid or absent;
X3 is any amino acid or absent;
X5 is Ala, Arg, Glu, Phe, Leu, Thr, Ser, Aib, Sarc, α-MeOrn, α-MeSer, Cit, Dap, Dab, Dap(Ac), Gly, Lys, Asn, N-MeGln, N-MeArg, Orn or Gln;
X6 is Asp, Thr, Asn, or Phe;
X8 is Val, Gln, Glu, or Lys;
X10 is Tyr Phe, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;
X11 is Trp, 1-Nal, 2-Nal, Phe(3,4-OMe$_2$) 5-Hydroxy-Trp, Phe(3,4-Cl$_2$) or Tyr(3-t-Bu);
X12 is His, Phe, Arg, N-Me-His, Val, Cav, Cpa, Leu, Cit, hLeu, 3-Pal, t-butyl-Ala, or t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Thr, Sarc, Glu, Phe, Arg, Leu, Lys, βhAla, Val, Aib, Lys(Ac), Cit, Asp, Dab, Dap, Glu, hArg, Lys, Asn, Orn, or Gln or absent;
X14 is Phe, Tyr, βhPhe, Asn, Arg, Gln, Lys(Ac), His; Dap(Ac), Dab(Ac) or Asp or absent;
X15 is Gly, Ser, Thr, Gln, Ala, Sarc, β-Ala, Glu, Arg or Asn or absent;
X16 is any amino acid or absent;
X17 is any amino acid or absent;
X18 is any amino acid or absent;
X19 is any amino acid or absent; and
X20 is any amino acid or absent,
wherein the Cys at position X4 and the Cys at position X9 are optionally linked by a disulphide bridge.

In certain embodiments of In: X5 is Ala, Arg, Glu, Phe, Leu, Thr, Ser, Aib, Sarc, α-MeOrn, α-MeSer, Cit, Dap, Dab, Dap(Ac), Gly, Lys, Asn, N-MeGln, N-MeArg, Orn or Gln;

X10 is Tyr, Phe, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr; X11 is Trp, 1-Nal, 2-Nal, Phe(3,4-OMe$_2$) 5-Hydroxy-Trp, Phe(3,4-Cl$_2$) or Tyr(3-t-Bu); X12 is His, Phe, Arg, N-Me-His, Val, Cav, Cpa, Leu, Cit, hLeu, 3-Pal, t-butyl-Ala, or t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys; X13 is Thr, Sarc, Glu, Phe, Arg, Leu, Lys, βhAla, Val, Aib, Lys(Ac), Cit, Asp, Dab, Dap, Glu, hArg, Lys, Asn, Orn, or Gln or absent; X14 is Phe, Tyr, βhPhe, Asn, Arg, Gln, Lys(Ac), His; Dap(Ac), Dab(Ac) or Asp or absent; X15 is Gly, Ser, Thr, Gln, Ala, Sarc, β-Ala, Glu, Arg or Asn or absent; X16 is Asp, Glu, Ala, AEA, AEP, βhAla, Gaba, or absent; and X17 is Leu, Lys, Arg, or absent.

In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln. In certain embodiments, X13 is Thr, Sarc, Glu, Phe, Arg, Leu, Lys, βhAla, or Aib.

In certain embodiments, X14 is Phe, Tyr, βhPhe, Asn, Arg, Gln, Lys(Ac), His; Dap(Ac), Dab(Ac) or Asp. In certain embodiments, X14 is Phe, Tyr, or βhPhe.

In certain embodiments, X15 is Gly, Ser, Thr, Gln, Ala, Sarc, β-Ala, Glu, Arg or Asn. In certain embodiments, X15 is Gly, Ser, Thr, Gln, Ala, or Sarc.

In certain embodiments, X12 is an alpha amino acid, e.g., 4-amino-4-carboxy-tetrahydropyran, Achc Acpc, Acbc, Acvc, Aib, α-DiethylGly, α-MeLys, α-MeLys(Ac), α-Me-Leu, α-MeOrn, α-MeSer, α-MeVal.

In certain embodiments, X13 is present.

In certain embodiments, X13 and X14 are present.

In certain embodiments, X13, X14 and X15 are present.

In certain embodiments of the peptide inhibitor of Formula I, X comprises or consists of the sequence of Formula Io:

X1-X2-X3-C-X5-X6-W-X8-C—Y-X11-H-X13-X14-X15-X16-X17-X18-X19-X20(Io)  (SEQ ID NO: 1112)

wherein

X1 is any amino acid or absent;
X2 is any amino acid or absent;
X3 is any amino acid or absent;
X5 is Ala, Arg, Glu, Phe, Leu, Thr, Ser, Aib, Sarc, α-MeOrn, α-MeSer, Cit, Dap, Dab, Dap(Ac), Gly, Lys, Asn, N-MeGln, N-MeArg, Orn or Gln;
X6 is Asp, Thr, Asn, or Phe;
X8 is Val, Gln, Glu, or Lys;
X11 is Trp, 1-Nal, 2-Nal, Phe(3,4-OMe$_2$) 5-Hydroxy-Trp, Phe(3,4-Cl$_2$) or Tyr(3-t-Bu);
X13 is Thr, Sarc, Glu, Phe, Arg, Leu, Lys, βhAla, Val, Aib, Lys(Ac), Cit, Asp, Dab, Dap, Glu, hArg, Lys, Asn, Orn, or Gln or absent;
X14 is Phe, Tyr, Asn, Arg, Gln, Lys(Ac), His; Dap(Ac), Dab(Ac) or Asp or absent;
X15 is Gly, Ser, Thr, Gln, Ala, Sarc, β-Ala, Glu, Arg or Asn or absent;
X16 is any amino acid or absent;
X17 is any amino acid or absent;
X18 is any amino acid or absent;
X19 is any amino acid or absent; and
X20 is any amino acid or absent,
wherein the Cys at position X4 and the Cys at position X9 are optionally linked by a disulphide bridge.

In certain embodiments of Io: X5 is Ala, Arg, Glu, Phe, Leu, Thr, Ser, Aib, Sarc, α-MeOrn, α-MeSer, Cit, Dap, Dab, Dap(Ac), Gly, Lys, Asn, N-MeGln, N-MeArg, Orn or Gln; X11 is Trp, 1-Nal, 2-Nal, Phe(3,4-OMe$_2$), 5-Hydroxy-Trp, Phe(3,4-Cl$_2$) or Tyr(3-t-Bu); X13 is Thr, Sarc, Glu, Phe, Arg, Leu, Lys, βhAla, Val, Aib, Lys(Ac), Cit, Asp, Dab, Dap, Glu, hArg, Lys, Asn, Orn, Gln or absent; X14 is Phe, Tyr, Asn, Arg, Gln, Lys(Ac), His; Dap(Ac), Dab(Ac) Asp or absent; X15 is Gly, Ser, Thr, Gln, Ala, Sarc, β-Ala, Glu, Arg or Asn or absent; X16 is Asp, Glu, Glu, Ala, AEA, AEP, βhAla, Gaba, or absent; and X17 is Leu, Lys, Arg, or absent.

In certain embodiments, X12 is an alpha amino acid, e.g., 4-amino-4-carboxy-tetrahydropyran, Achc Acpc, Acbc, Acvc, Aib, α-DiethylGly, α-MeLys, α-MeLys(Ac), α-Me-Leu, α-MeOrn, α-MeSer, α-MeVal.

In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln. In certain embodiments, X13 is Thr, Sarc, Glu, Phe, Arg, Leu, Lys, βhAla or Aib.

In certain embodiments, X14 is Phe, Tyr, Asn, Arg, Gln, Lys(Ac), His; Dap(Ac), Dab(Ac) or Asp. In certain embodiments, X14 is Phe or Tyr.

In certain embodiments, X15 is Gly, Ser, Thr, Gln, Ala, Sarc, β-Ala, Glu, Arg or Asn. In certain embodiments, X15 is Gly, Ser, Thr, Gln, Ala or Sarc.

In certain embodiments, X13 is present.
In certain embodiments, X13 and X14 are present.
In certain embodiments, X13, X14 and X15 are present.
In certain embodiments of the peptide inhibitor of Formula I, X comprises or consists of the sequence of Formula Ip:

X1-X2-X3-C-X5-X6-W-X8-C-Y-X11-H-X13-F-X15-X16-X17-X18-X19-X20(Ip)    (SEQ ID NO: 1113)

wherein
X1 is any amino acid or absent;
X2 is any amino acid or absent;
X3 is any amino acid or absent;
X5 is Ala, Arg, Sarc, α-MeOrn, α-MeSer, Cit, Dap, Dab, Dap(Ac), Gly, Lys, Asn, N-MeGln, N-MeArg, Orn or Gln;
X6 is Asp, Thr, or Asn;
X8 is Val, Gln, or Glu;
X11 is Trp, 1-Nal, 2-Nal, Phe(3,4-OMe$_2$) 5-Hydroxy-Trp, Phe(3,4-Cl$_2$) or Tyr(3-t-Bu);
X13 is Thr, Sarc, Glu, Phe, Arg, Leu, Lys, βhAla, Val, Aib, Lys(Ac), Cit, Asp, Dab, Dap, Glu, hArg, Lys, Asn, Orn, Gln or absent;
X15 is Gly, Ser, Thr, Gln, Ala, Sarc, β-Ala, Glu, Arg Asn or absent;
X16 is any amino acid or absent;
X17 is any amino acid or absent;
X18 is any amino acid or absent;
X19 is any amino acid or absent; and
X20 is any amino acid or absent,
    wherein the Cys at position X4 and the Cys at position X9 are optionally linked by a disulphide bridge.

In certain embodiments of Ip: X5 is Ala, Arg, or Sarc; X11 is Trp, 1-Nal, or 2-Nal; X13 is Thr, Sarc, Glu, Phe, Arg, Leu, Lys, βhAla, Val, Aib or absent; X15 is Gly, Ser, Thr, Gln, Ala, Sarc or absent; X16 is Asp, Glu, Ala, AEA, AEP, βhAla, Gaba, or absent; and X17 is Leu, Lys, Arg, or absent.

In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln. In certain embodiments, X13 is Thr, Sarc, Glu, Phe, Arg, Leu, Lys, βhAla or Aib.

In certain embodiments, X15 is Gly, Ser, Thr, Gln, Ala or Sarc, β-Ala, Glu, Arg or Asn. In certain embodiments, X15 is Gly, Ser, Thr, Gln, Ala or Sarc.

In certain embodiments, X13 is present.
In certain embodiments, X13 and X14 are present.
In certain embodiments, X13, X14 and X15 are present.
In certain embodiments of the peptide inhibitor of Formula I, X comprises or consists of the sequence of Formula Iq:

X1-X2-X3-C-X5-X6-W-X8-C-X10-X11-X12-X13-X14-X15-X16-X17-X18-X19-X20 (Iq), wherein X1 is any amino acid or absent;
X2 is any amino acid or absent;
X3 is any amino acid or absent;
X5 is Ala, Arg, Glu, Phe, Leu, Thr, Ser, Aib, Sarc, D-Ala, D-Arg, D-Glu, D-Phe, D-Leu, D-Thr, D-Ser, D-Aib, D-Sarc, α-MeOrn, α-MeSer, Cit, Dap, Dab, Dap(Ac), Gly, Lys, Asn, N-MeGln, N-MeArg, Orn or Gln;
X6 is Asp, Thr, Asn, Phe, D-Asp, D-Thr, D-Asn, or D-Phe;
X8 is Val, Gln, Glu, or Lys;
X10 is Tyr, Phe, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;
X11 is Trp, 1-Nal, 2-Nal, Phe(3,4-OMe$_2$) 5-Hydroxy-Trp, Phe(3,4-Cl$_2$) or Tyr(3-t-Bu);
X12 is His, Phe, Arg, N-Me-His, Val, or D-His, Cav, Cpa, Leu, Cit, hLeu, 3-Pal, t-butyl-Ala, t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Thr, Sarc, Glu, Phe, Arg, Leu, Lys, βhAla, Val, Aib, Lys(Ac), Cit, Asp, Dab, Dap, Glu, hArg, Lys, Asn, Orn, Gln or absent;
X14 is Phe, Tyr, βhPhe, Asn, Arg, Gln, Lys(Ac), His; Dap(Ac), Dab(Ac), Asp or absent;
X15 is Gly, Ser, Thr, Gln, Ala, Sarc, β-Ala, Glu, Arg, Asn or absent;
X16 is any amino acid or absent;
X17 is any amino acid or absent;
X18 is any amino acid or absent;
X19 is any amino acid or absent; and
X20 is any amino acid or absent,
    wherein the Cys at position X4 and the Cys at position X9 are optionally linked.

In certain embodiments of Iq: X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X10 is Tyr or Phe; X11 is Trp, 1-Nal, or 2-Nal; X12 is His, Phe, Arg, N-Me-His, Val, or D-His, Cav, Cpa, Leu, Cit, hLeu, 3-Pal, t-butyl-Ala, or t-butyl-Gly; X13 is Thr, Sarc, Glu, Phe, Arg, Leu, Lys, βhAla, Val, Aib or absent; X14 is Phe, Tyr, βhPhe or absent; X15 is Gly, Ser, Thr, Gln, Ala, Sarc or absent; X16 is Asp, Glu, Ala, AEA, AEP, βhAla, Gaba, Leu, or absent; and X17 is Leu, Lys, Arg, or absent.

In certain embodiments, X12 is alpha amino acid, e.g., 4-amino-4-carboxy-tetrahydropyran, Achc Acpc, Acbc, Acvc, Aib, α-DiethylGly, α-MeLys, α-MeLys(Ac), α-Me-Leu, α-MeOrn, α-MeSer, α-MeVal.

In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln. In certain embodiments, X13 is Thr, Sarc, Glu, Phe, Arg, Leu, Lys, βhAla or Aib.

In certain embodiments, X14 is Phe, Tyr, βhPhe, Asn, Arg, Gln, Lys(Ac), His; Dap(Ac), Dab(Ac), or Asp. In certain embodiments, X14 is Phe, Tyr or βhPhe.

In certain embodiments, X15 is Gly, Ser, Thr, Gln, Ala, Sarc, β-Ala, Glu, Arg or Asn. In certain embodiments, X15 is Gly, Ser, Thr, Gln, Ala or Sarc.

In certain embodiments, X13 is present.

In certain embodiments, X13 and X14 are present.

In certain embodiments, X13, X14 and X15 are present.

In certain embodiments, Iq comprises or consists of the sequence of Formula Iq':

X1-X2-X3-C-X5-X6-W-X8-C-X10-X11-X12-X13-X14-X15    (Iq'), wherein X1-X14 have the definition provided for Iq, and wherein the Cys at position X4 and the Cys at position X9 are optionally linked.

In certain embodiments of Iq': X5 is Ala, Arg, Glu, Phe, Leu, Thr, Ser, Aib, Sarc, D-Ala, D-Arg, D-Glu, D-Phe, D-Leu, D-Thr, D-Ser, D-Aib, or D-Sarc; X10 is Tyr or Phe; X11 is Trp, 1-Nal, or 2-Nal; X12 is His, Phe, Arg, N-Me-His, Val, or D-His, Cav, Cpa, Leu, Cit, hLeu, 3-Pal, t-butyl-Ala, or t-butyl-Gly; X13 is Thr, Sarc, Glu, Phe, Arg, Leu, Lys, βhAla, Val, Aib or absent; X14 is Phe, Tyr, βhPhe or absent; X15 is Gly, Ser, Thr, Gln, Ala, Sarc or absent; X16 is Asp, Glu, Ala, AEA, AEP, βhAla, Gaba, Leu, or absent; and X17 is Leu, Lys, Arg, or absent.

In certain embodiments, X13 is Thr, Sarc, Glu, Phe, Arg, Leu, Lys, βhAla, Aib, Lys(Ac), Cit, Asp, Dab, Dap, Glu, hArg, Lys, Asn, Orn, or Gln. In certain embodiments, X13 is Thr, Sarc, Glu, Phe, Arg, Leu, Lys, βhAla or Aib.

In certain embodiments, X14 is Phe, Tyr, βhPhe, Asn, Arg, Gln, Lys(Ac), His; Dap(Ac), Dab(Ac) or Asp. In certain embodiments, X14 is Phe, Tyr or βhPhe.

In certain embodiments, X15 is Gly, Ser, Thr, Gln, Ala or Sarc, β-Ala, Glu, Arg or Asn. In certain embodiments, X14 is Phe, Tyr or βhPhe.

In certain embodiments, X13 is present.

In certain embodiments, X13 and X14 are present.

In certain embodiments, X13, X14 and X15 are present.

In certain embodiments of the peptide inhibitor of Formula I, X comprises or consists of the sequence of Formula Ir:

X1-X2-X3-X4-X5-X6-X7-X8-X9-X10-X11-X12-X13-X14-X15-X16-X17-X18-X19-X20    (Ir)

wherein
X1 is any amino acid or absent;
X2 is any amino acid or absent;
X3 is any amino acid or absent;
X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys, Sec, 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid, Abu, β-azido-Ala-OH, propargylglycine, 2-(3'-butenyl)glycine, 2-allylglycine, 2-(3'-butenyl)glycine, 2-(4'-pentenyl)glycine, 2-(5'-hexenyl)glycine, Abu or absent;
X5 is any amino acid;
X6 is any amino acid;
X7 is Trp, Glu, Gly, Ile, Asn, Pro, Arg, Thr or OctGly, or a corresponding α-methyl amino acid form of any of the foregoing;
X8 is any amino acid;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, or Ser, Sec, Abu, β-azido-Ala-OH, propargylglycine, 2-2-allylglycine, 2-(3'-butenyl)glycine, 2-(4'-pentenyl)glycine, Ala, hCys, Abu, Met, MeCys, (D)Tyr or 2-(5'-hexenyl)glycine;
X10 is Tyr, Phe(4-OMe), 1-Nal, 2-Nal, Aic, α-MePhe, Bip, (D)Cys, Cha, DMT, (D)Tyr, Glu, His, hPhe(3,4-dimethoxy), hTyr, N-Me-Tyr, Trp, Phe(4-CONH$_2$), Phe(4-phenoxy), Thr, Tic, Tyr(3-tBu), Phe(4-tBu), Phe(4-CN), Phe(4-Br), Phe(4-NH$_2$), Phe(4-F), Phe(3,5-F$_2$), Phe(4-CH$_2$CO$_2$H), Phe(penta-F), Phe(3,4-Cl$_2$), Phe(4-CF$_3$), Bip, Cha, 4-PyridylAlanine, βhTyr, OctGly, Phe(4-N$_3$), Phe(4-Br), Phe[4-(2-aminoethoxy)] or Phe, a Phe analog, a Tyr analog, or a corresponding α-methyl amino acid form of any of the foregoing;
X11 is 2-Nal, 1-Nal, 2,4-dimethylPhe, Bip, Phe(3,4-Cl$_2$), Phe(3,4-F$_2$), Phe(4-CO$_2$H), βhPhe(4-F), α-Me-Trp, 4-phenylcyclohexyl, Phe(4-CF$_3$), Phe(3,4-OMe$_2$), α-MePhe, βhNal, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe (4-guanidino, Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe (4-CONH$_2$), Phe(3,4-Dimethoxy), Phe(2,3-Cl$_2$), Phe(2,3-F$_2$), Phe(4-F), 4-phenylcyclohexylalanine or Bip, or a corresponding α-methyl amino acid form of any of the foregoing;
X12 is His, Phe, Arg, N-Me-His, or Val, Cav, Cpa, Leu, Cit, hLeu, 3-Pal, t-butyl-Ala, α-MeLys, D-Ala, (D)Asn, (D)Asp, (D)Leu, (D)Phe, (D)Tyr, Aib, α-MeLeu, α-MeOrn, β-Aib, β-Ala, βhAla, βhArg, βhLeu, βhVal, β-spiro-pip, Glu, hArg, Ile, Lys, N-MeLeu, N-MeArg, Ogl, Orn, Pro, Gln, Ser, Thr, Tle or t-butyl-Gly, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys or a corresponding α-methyl amino acid form of any of the foregoing;
X13 is Thr, Sarc, Glu, Phe, Arg, Leu, Asn, Cit, Lys, Arg, Orn, Val, βhAla, Lys(Ac), (D)Asn, (D)Leu, (D)Phe, (D)Thr, Ala, α-MeLeu, Aib, β-Ala, β-Glu, βhLeu, βhVal, β-spiro-pip, Cha, Chg, Asp, Dab, Dap, α-DiethylGly, hLeu, Asn, Ogl, Pro, Gln, Ser, β-spiro-pip, Thr, Tba, Tle or Aib, or a corresponding α-methyl amino acid form of any of the foregoing;
X14 is Phe, Tyr, Glu, Gly, His, Lys, Leu, Met, Asn, Lys(Ac), Dap(Ac), Asp, Pro, Gln, Arg, Ser, Thr, Tic or βhPhe, or a corresponding α-methyl amino acid form of any of the foregoing;
X15 is Gly, Ser, Thr, Gln, Ala, (D)Ala, (D)Asn, (D)Asp, (D)Leu, (D)Phe, (D)Thr, Aea, Asp, Asn, Glu, Phe, Gly, Lys, Leu, Pro, Arg, β-Ala, or Sarc, or a corresponding α-methyl amino acid form of any of the foregoing;
X16 is any amino acid or absent;
X17 is any amino acid or absent;
X18 is any amino acid or absent;
X19 is any amino acid or absent; and
X20 is any amino acid or absent.

In particular embodiments, the peptide is cyclized via X4 and X9.

In particular embodiments, X3 is Glu, D-Glu, Arg, (D)Arg, Phe, (D)Phe, 2-Nal, Thr, Leu, (D)Gln.

In certain embodiments of Ir: X11 is 2-Nal, 1-Nal, 2,4-dimethylPhe, Bip, Phe(3,4-Cl$_2$), Phe(3,4-F$_2$), Phe(4-CO$_2$H), βhPhe(4-F), α-Me-Trp, 4-phenylcyclohexyl, Phe(4-CF$_3$), α-MePhe, βhNal, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino, Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe(4-CONH₂), Phe(3,4-Dimethoxy), Phe(2,3-Cl₂), Phe(2,3-F₂), Phe(4-F), 4-phenylcyclohexylalanine or Bip, or a corresponding α-methyl amino acid form of any of the foregoing; X12 is His, Phe, Arg, N-Me-His, or Val, Cav, Cpa, Leu, Cit, hLeu, 3-Pal, t-butyl-Ala, α-MeLys, D-Ala, (D)Asn, (D)Asp, (D)Leu, (D)Phe, (D)Tyr, Aib, α-MeLeu, α-MeOrn, β-Aib, β-Ala, βhAla, βhArg, βhLeu, βhVal, β-spiro-pip, Glu, hArg, Ile, Lys, N-MeLeu, N-MeArg, Ogl, Orn, Pro, Gln, Ser, Thr, Tle or t-butyl-Gly, or a corresponding α-methyl amino acid form of any of the foregoing; X13 is Thr, Sarc, Glu, Phe, Arg, Leu, Lys, Arg, Orn, Val, βhAla, Lys(Ac), (D)Asn, (D)Leu, (D)Phe, (D)Thr, Ala, α-MeLeu, Aib, β-Ala, β-Glu, βhLeu, βhVal, β-spiro-pip, Cha, Chg, Asp, Dab, Dap, α-DiethylGly, hLeu, Asn, Ogl, Pro, Gln, Ser, β-spiro-pip, Thr, Tba, Tle or Aib, or a corresponding α-methyl amino acid form of any of the foregoing; X14 is Phe, Tyr, Glu, Gly, His, Lys, Leu, Met, Asn, Pro, Gln, Arg, Ser, Thr, Tic or βhPhe, or a corresponding α-methyl amino acid form of any of the foregoing; X15 is Gly, Ser, Thr, Gln, Ala, (D)Ala, (D)Asn, (D)Asp, (D)Leu, (D)Phe, (D)Thr, Aea, Asp, Asn, Glu, Phe, Gly, Lys, Leu, Pro, Arg or Sarc, or a corresponding α-methyl amino acid form of any of the foregoing; X16 is Asp, Glu, Ala, AEA, AEP, βhAla, Gaba, Gly, Ser, Pro, Asn, Thr or absent, or a corresponding α-methyl amino acid form of any of the foregoing; and X17 is Leu, Lys, Arg, Glu, Ser, Gly, Gln or absent, or a corresponding α-methyl amino acid form of any of the foregoing.

In certain embodiments, both X4 and X9 are Pen. In particular embodiments, X4 and X9 are cyclized via a disulfide bond.

In certain embodiments, X4 is Abu and X9 is Cys. In certain embodiments, X4 and X9 are cyclized via a thioether bond.

In particular embodiments, X5 is Ala, Arg, Glu, Phe, Leu, Thr, Ser, Aib, Sarc, D-Ala, D-Arg, D-Glu, D-Phe, D-Leu, D-Thr, D-Ser, D-Aib, Cys, Cit, Asp, Dab, Dap, Gly, His, hCys, Lys, Met, Asn, N-Me-Ala, N-Me-Asn, N-Me-Lys, N-Me-Gln, Orn, Pro, Pen, Gln, Val, αMe-Lys, αMe-Orn, or D-Sarc, α-MeOrn, α-MeSer, Cit, Dap, Dab, Dap(Ac), Gly, Lys, Asn, N-MeGln, N-MeArg, or Gln. In certain embodiments, X5 is Gln or Asn. In particular embodiments, X5 is Ala, Arg, Glu, Phe, Leu, Thr, Ser, Aib, Sarc, D-Ala, D-Arg, D-Glu, D-Phe, D-Leu, D-Thr, D-Ser, D-Aib, Cys, Cit, Asp, Dab, Dap, Gly, His, hCys, Lys, Met, Asn, N-Me-Ala, N-Me-Asn, N-Me-Lys, N-Me-Gln, N-Me-Arg, Orn, Pro, Pen, Gln, Val, αMe-Lys, αMe-Orn, or D-Sarc. In certain embodiments, X5 is Gln.

In particular embodiments, X6 is Asp, Thr, Asn, Phe, D-Asp, D-Thr, D-Asn, Glu, Arg, Ser or D-Phe. In particular embodiments, X6 is Thr.

In particular embodiments, X7 is Trp.

In particular embodiments, X8 is Val, Gln, Glu, Phe, Asn, Pro, Arg, Thr, Trp or Lys. In particular embodiments, X8 is Gln.

In particular embodiments, X1, X2 and X3 are absent.

In certain embodiments, X11 is a Trp analog.

In particular embodiments, X10 is a Phe analog. In particular embodiments, X10 is Phe(4-OMe), Phe(4-CONH₂), or Phe[4-(2-aminoethoxy)] (also referred to herein as Phe[4-2ae])). In particular embodiments, X10 is Phe(4-OMe) or Phe[4-(2-aminoethoxy)] (also referred to herein as Phe[4-2ae])).

In particular embodiments, X11 is 2-Nal or 1-Nal. In certain embodiments, X11 is 2-Nal.

In certain embodiments, X12 is α-MeLys, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, or α-MeVal. In certain embodiments, X12 is α-MeLys.

In certain embodiments, X13 is Glu or Lys(Ac). In certain embodiments, X13 is Glu.

In certain embodiments, X14 is Asn.

In certain embodiments, X15 is Gly or Asn. In certain embodiments, X15 is Gly.

In certain embodiments, one or more, two or more, three or more, or four or more of X16, X17, X18, X19 and X20 are absent. In particular embodiments, X16, X17, X18, X19 and X20 are absent.

In particular embodiments of Ir, X4 and X9 are Cys, X7 is Trp, and X18 is [(D)Lys]. In particular embodiments of Ir, X4 and X9 are Cys, X7 is Trp, X10 is Tyr, and X18 is [(D)Lys]. In particular embodiments of Ir, X4 and X9 are Cys, X7 is Trp, X1, X2 and X3 are absent, X17 is absent, X18 is [(D)Lys], and X19 and X20 are absent. In particular embodiments of Ir, X4 and X9 are Cys, X7 and X11 are Trp, X10 is Tyr, and X18 is [(D)Lys. In certain embodiments, X1, X2, and X3 are absent; and in certain embodiments, X17 is absent.

In particular embodiments of Ir, X4 and X9 are Pen, and X12 is α-MeLys. In particular embodiments of Ir, X4 and X9 are Pen, X12 is α-MeLys, and X16, X17, X18, X19 and X20 are absent. In particular embodiments of Ir, X4 and X9 are Pen, X12 is α-MeLys, 4-amino-4-carboxy-tetrahydropyran, Achc Acpc, Acbc, Acvc, Agp, Aib, α-DiethylGly, α-MeLys(Ac), α-Me-Leu, α-MeOrn, α-MeSer, α-MeVal, X16, X17, X18, X19 and X20 are absent, and X7 is Trp. In particular embodiments of Ir, X4 and X9 are Pen, X12 is α-MeLys, X16, X17, X18, X19 and X20 are absent, and X7 is Trp. In particular embodiments of Ir, X4 and X9 are Pen, X7 is Trp, and X12 is α-MeLys. In certain embodiments, X1, X2, and X3 are absent. In particular embodiments, there is a disulfide bond between X4 and X9.

In particular embodiments of Ir, X4 is Abu, X9 is Cys, and X12 is 4-amino-4-carboxy-tetrahydropyran, Achc Acpc, Acbc, Acvc, Agp, Aib, α-DiethylGly, α-MeLys, or α-MeLys(Ac), α-Me-Leu, α-MeOrn, α-MeSer, or α-MeVal. In particular embodiments of Ir, X4 is Abu, X9 is Cys, and X12 is α-MeLys. In particular embodiments of Ir, X4 is Abu, X9 is Cys, X12 is α-MeLys, 4-amino-4-carboxy-tetrahydropyran, Achc Acpc, Acbc, Acvc, Agp, Aib, α-DiethylGly, α-MeLys, or α-MeLys(Ac), α-Me-Leu, α-MeOrn, α-MeSer, or α-MeVal and X16, X17, X18, X19 and X20 are absent. In particular embodiments of Ir, X4 is Abu, X9 is Cys, X12 is α-MeLys, and X16, X17, X18, X19 and X20 are absent. In particular embodiments of Ir, X4 is Abu, X9 is Cys, X12 is α-MeLys, 4-amino-4-carboxy-tetrahydropyran, Achc Acpc, Acbc, Acvc, Agp, Aib, α-DiethylGly, α-MeLys, or α-MeLys(Ac), α-Me-Leu, α-MeOrn, α-MeSer, or α-MeVal, X16, X17, X18, X19 and X20 are absent, and X7 is Trp. In particular embodiments of Ir, X4 is Abu, X9 is Cys, X12 is α-MeLys, X16, X17, X18, X19 and X20 are absent, and X7 is Trp. In particular embodiments of Ir, X4 is Abu, X9 is Cys, X7 is Trp, and X12 is α-MeLys. In certain embodiments, X1, X2, and X3 are absent. In particular embodiments, there is a thioether bond between X4 and X9.

In certain embodiments of the peptide inhibitor of Formula I, X comprises or consists of the sequence of Formula Is:

X1-X2-X3-C-X5-X6-W-X8-C-X10-X11-X12-X13-
X14-G-X16-X17-X18-X19-X20(Is)    (SEQ ID NO: 1114)

wherein

X1 is any amino acid or absent;
X2 is any amino acid or absent;
X3 is any amino acid or absent;
X5 is any amino acid;
X6 is any amino acid;
X8 is any amino acid;
X10 is Tyr, 1-Nal 2-Nal, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe(4-CN), Phe(4-guanidino), Phe(4-Me), Phe(4-NH$_2$), Phe(4-N$_3$), Phe(4-OMe), Phe(4-OBzl) or Tyr;
X11 is Trp 1-Nal, Phe(3,4-OMe$_2$) 5-Hydroxy-Trp, Phe(3,4-Cl$_2$) or Tyr(3-t-Bu);
X12 is Arg, Lys, His, hArg, Cit, Orn, 1-Nal, D-Ala, D-Leu, D-Phe, D-Asn, D-Asp, Agp, Leu, βhLeu, Aib, βhAla, βhVal, βhArg, hLeu, Dap, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer, α-MeVal, Cha, Cit, Cpa, (D)Asn, Glu, hArg, or Lys;
X13 is Cha, Ogl, Aib, Leu, Val, Dab, Glu, Lys, βhLeu, βhAla, βhVal βGlu, Lys(Ac), Cit, Asp, Dab, Dap, Glu, hArg, Lys, Asn, Orn, Lys(Ac), or Gln;
X14 is Phe, Tic, Asn Tyr, Asn, Arg, Gln, Lys(Ac), His; Dap(Ac), Dab(Ac) or Asp;
X16 is any amino acid;
X17 is absent;
X18 is D-Lys;
X19 is any amino acid or absent; and
X20 is any amino acid or absent.

In particular embodiments of Is: X10 is Tyr, 1-Nal or 2-Nal; X11 is Trp or 1-Nal; X12 is Arg, Lys, His, hArg, Cit, Orn, 1-Nal, D-Ala, D-Leu, D-Phe, D-Asn, D-Asp, Agp, Leu, βhLeu, Aib, βhAla, βhVal, βhArg, hLeu or Dap; X13 is Cha, Ogl, Aib, Leu, Val, Dab, Glu, Lys, βhLeu, βhAla, βhVal or βGLu; X14 is Phe, Tic, Asn or Tyr; and X16 is AEA, Ala or βAla.

In particular embodiments, X5 is Glu, Arg, Ala, N-Me-Arg, N-Me-Ala, N-Me-Gln, Orn, N-Me-Asn, N-Me-Lys, Ser, Gln, Orn, Asn or Dap. In particular embodiments, X5 is Glu, Arg, Ala, N-Me-Arg, N-Me-Ala, N-Me-Gln, Orn, N-Me-Asn, N-Me-Lys, Ser, Asn or Dap.

In particular embodiments, X6 is Asp or Thr.
In particular embodiments, X8 is Gln or Val.
In particular embodiments, the peptide of Is is cyclized via a disulfide bond between X4 and X9.

In certain embodiments of the peptide inhibitor of Formula I, X comprises or consists of the sequence of Formula It:

X1-X2-X3-C-X5-X6-W-X8-C-X10-X11-X12-X13-X14-X15-X16-X17-X18-X19-X20  (It)

wherein
X1 is any amino acid or absent;
X2 is any amino acid or absent;
X3 is any amino acid or absent;
X5 is any amino acid;
X6 is any amino acid;
X8 is any amino acid;
X10 is Tyr, 1-Nal, 2-Nal, Phe[4-(2-aminoethoxy)], Phe(4-CONH$_2$), Phe(4-OMe);
X11 is Trp, 1-Nal, 2-Nal, Bip, Phe(3,4-OMe$_2$) 5-Hydroxy-Trp;
X12 is Arg, His, 3-Pal, Leu, Thr, Gln, Asn, Glu, Ile, Phe, Ser, Lys, hLeu, α-MeLeu, D-Leu, D-Asn, h-Leu, 4-amino-4-carboxy-tetrahydropyran, Achc Acpc, Acbc, Acvc, Agp, Aib, α-DiethylGly, α-MeLys, α-MeLys(Ac), α-Me-Leu, α-MeOrn, α-MeSer or α-MeVal;
X13 is Thr, Glu, Tyr, Lys, Gln, Asn, Lys, Lys (Ac), Asp, Arg, Ala, Ser, Leu;
X14 is Phe, Tyr, Asn, Gly, Ser, Met, Arg, His, Lys, Leu or Gln;
X15 is Gly, Ser, Arg, Leu, Asp, Ala, β-Ala, Glu, Arg or Asn;
X16 is absent or any amino acid;
X17 is absent or any amino acid;
X18 is any amino acid or absent;
X19 is any amino acid or absent; and
X20 is any amino acid or absent.

In certain embodiments of It: X10 is Tyr, 1-Nal or 2-Nal; X11 is Trp, 1-Nal, 2-Nal or Bip; X12 is Arg, His, 3-Pal, Leu, Thr, Gln, Asn, Glu, Ile, Phe, Ser, Lys, hLeu, α-MeLeu, D-Leu, D-Asn, or h-Leu; X13 is Thr, Glu, Tyr, Lys, Gln, Asn, Lys, Asp, Arg, Ala, Ser, Leu; X15 is Gly, Ser, Arg, Leu, Asp or Ala; X16 is absent or Asn, Glu, Phe, Ala, Gly, Pro, Asp, Gln, Ser, Thr, D-Glu or Lys; and X17 is absent or Pro, Arg, Glu, Asp, Ser, Gly or Gln.

In particular embodiments, X5 is Ser, Asp, Asn, Gln, Ala, Met, Arg, His or Gly. In particular embodiments, X5 is Ser, Asp, Gln, Ala, Met, Arg, His or Gly.

In particular embodiments, X6 is any Asp, Ser or Thr.
In particular embodiments, X8 is Gln, Glu or Thr.
In particular embodiments, the peptide of It is cyclized via a disulfide bond between X4 and X9.

Any of the peptide inhibitors of the present invention (e.g., any of those of Formula I (e.g., Ix, Ia-It) may be further defined, e.g., as described below. It is understood that each of the further defining features described herein may be applied to any peptide inhibitors where the amino acids designated at particular positions allow the presence of the further defining feature.

In certain embodiments, the peptide inhibitor is cyclized by a disulphide bridge.

In certain embodiments, X10 is Tyr, Phe[4-(2-aminoethoxy)], Phe(4-CONH$_2$) or Phe(4-OMe). In certain embodiments, X10 is Tyr.

In certain embodiments, X11 is 2-Nal, Trp, or 5-Hydroxy-Trp. In certain embodiments, X11 is Trp.

In certain embodiments, X10 is Tyr or Phe[4-(2-aminoethoxy)], and X11 is Trp or 2-Nal. In certain embodiments, X10 is Tyr and X11 is Trp.

In particular embodiments, X4 and X9 are both Cys.
In particular embodiments, X4 is Cys, Pen, hCys, or absent.
In particular embodiments, X7 and X11 are not both W.
In particular embodiments, X7 and X11 are both W.
In particular embodiments, X7 and X11 are both W, X10 is Y, and X4 and X9 are both Cys.
In particular embodiments, X15 is Gly, Asn, β-ala or Ser.
In particular embodiments, X15 is Gly or Ser.
In particular embodiments, X16 is AEA or AEP.
In particular embodiments, X10 is Tyr, Phe or Phe[4-(2-aminoethoxy). In particular embodiments, X10 is Tyr or Phe.
In particular embodiments, X11 is Trp or 2-Nal. In particular embodiments, X11 is Trp.
In particular embodiments, X1, X2 and X3 are absent.
In particular embodiments, X18, X19 and X20 are absent.
In particular embodiments, X1, X2, X3, X18, X19 and X20 are absent.
In particular embodiments, one or more of X1, X2 or X3 are present.

In particular embodiments of any of Ix, Ia-Ir, one of X1, X2 and X3 is present and the other two are absent. In one embodiment, the X1, X2 or X3 present is Ala.

In certain embodiments, X3 is present. In particular embodiments, X3 is Glu, (D)Glu, Arg, (D)Arg, Phe, (D)Phe, 2-Nal, Thr, Leu, (D)Gln. In certain embodiments, X3 is (D)Arg or (D)Phe. In particular embodiments, X1 and X2 are absent and X3 is present.

In particular embodiments, two of X1, X2 and X3 are present and the other one is absent. In certain embodiments, the two present consist of SG, NK, DA, PE, QV or DR.

In particular embodiments, X1, X2 and X3 are present. In certain embodiments, X1, X2 and X3 consist of ADQ, KEN, VQE, GEE, DGF, NAD, ERN, RVG, KAN, or YED.

In certain embodiments, the peptide comprises an AEP residue. In particular embodiments, any of X15, X16, X17, X18, X19 or X20 is AEP.

In certain embodiments of any of the peptide inhibitors or peptide monomer subunits, X13 is Thr, Sarc, Glu, Phe, Arg, Leu, Lys, Lys(Ac), βhAla, or Aib. In certain embodiments of any of the peptide inhibitors or peptide monomer subunits, X13 is Thr, Sarc, Glu, Phe, Arg, Leu, Lys, βhAla, or Aib. In certain embodiments, X14 is Phe, Asn, Tyr, or βhPhe. In certain embodiments, X14 is Phe, Tyr, or βhPhe. In certain embodiments, X15 is Gly, Asn Ser, Thr, Gln, Ala, or Sarc. In certain embodiments, X15 is Gly, Ser, Thr, Gln, Ala, or Sarc. In certain embodiments, X12 is alpha amino acid, e.g., 4-amino-4-carboxy-tetrahydropyran, Achc Acpc, Acbc, Acvc, Aib, α-DiethylGly, α-MeLys, α-MeLys(Ac), α-MeLeu, α-MeOrn, α-MeSer, or α-MeVal.

In certain embodiments, X13 is present.
In certain embodiments, X13 and 14 are present.
In certain embodiments, X13, X14 and X15 are present.

In particular embodiments of any one of Ia-It, one or more of X16-X20 are present. In particular embodiments, two or more or three or more of X16-X20 are present. In particular embodiments, X18 is [(D)Lys]. In particular embodiments, X17 is absent, and X18 is [(D)Lys]. In certain embodiments wherein X4 and X9 are optionally Cys, X4 and X9 are Cys, X7 is Trp, and X18 is [(D)Lys]. In particular embodiments wherein X4 and X9 are optionally Cys, X4 and X9 are Cys, X7 is Trp, X10 is Tyr or Phe[4-(2-aminoethoxy)], and X18 is [(D)Lys]. In particular embodiments wherein X4 and X9 are optionally Cys, X4 and X9 are Cys, X7 is Trp, X10 is Tyr, and X18 is [(D)Lys]. In particular embodiments wherein X4 and X9 are optionally Cys, X4 and X9 are Cys, X7 is Trp, X1, X2 and X3 are absent, X17 is absent, X18 is [(D)Lys], and X19 and X20 are absent. In particular embodiments of Ir, X4 and X9 are Cys, X7 and X11 are Trp, X10 is Tyr, and X18 is [(D)Lys]. In certain embodiments, X1, X2, and X3 are absent; and in certain embodiments, X17 is absent.

In certain embodiments, any of the peptide inhibitors (or monomer subunits) described herein is cyclized. In particular embodiments, the peptide inhibitor is cyclized via a bond between two or more internal amino acids of the peptide inhibitor. In particular embodiments, cyclized peptide inhibitors are not cyclized via a bond between the N-terminal and C-terminal amino acids of the peptide inhibitor. In certain embodiments, one of the amino acid residues participating in the intramolecular bond cyclizing the peptide in the amino terminal amino acid residue. In certain embodiments, any of the peptide inhibitors in cyclized via a peptide bond between its N-terminal amino acid and its C-terminal amino acid.

In certain embodiments of any of the peptide inhibitors, or one or both monomer subunits thereof, the peptide inhibitor (or one or both monomer subunit thereof) is cyclized via an intramolecular bond between X4 and X9 or by a triazole ring. In particular embodiments, the intramolecular bond is any disulfide bond, a thioether bond, a lactam bond, a triazole, a selenoether bond, a diselenide bond, or an olefin bond.

In one embodiment, X4 and X9 of the peptide inhibitor (or one or both monomer subunits thereof) are Cys, Pen, hCys, D-Pen, D-Cys or D-hCys, and the intramolecular bond is a disulfide bond. In certain embodiments, both X4 and X9 are Cys, or both X4 and X9 are Pen, and the intramolecular bond is a disulfide bond.

In one embodiment, X4 and X9 of the peptide inhibitor (or one or both monomer subunits thereof) are Glu, Asp, Lys, Orn, Dap, Dab, D-Dap, D-Dab, D-Asp, D-Glu or D-Lys, and the intramolecular bond is a lactam bond.

In one embodiment, X4 is Abu, 2-chloromethylbenzoic acid, mercapto-propanoic acid, mercapto-butyric acid, 2-chloro-acetic acid, 3-chloro-propanoic acid, 4-chloro-butyric acid, or 3-chloro-isobutyric acid; X9 is Abu, Cys, Pen, hCys, D-Pen, D-Cys or D-hCys; and the intramolecular bond is a thioether bond. In certain embodiments, X4 is Abu and X9 is Pen, and the intramolecular bond is a thioether bond. In particular embodiments, X4 is a 2-methylbenzoyl moiety capable of forming a thioether bond with X9, and X9 is selected from Cys, N-Me-Cys, D-Cys, hCys, Pen, and D-Pen. In particular embodiments, X4 is Abu and X9 is Cys, and the intramolecular bond is a thioether bond. In particular instances, a peptide monomer, dimer, or subunit thereof of any of the Formulas and peptides described herein, X4 is selected from the group consisting of modified Ser, modified hSer (e.g., Homo-Ser-Cl), a suitable isostere, and corresponding D-amino acids. In other instances, X4 is an aliphatic acid having from one to four carbons and forming a thioether bond with X9. In some instances, X4 is a five- or six-membered alicyclic acid having a modified 2-methyl group that forms a thioether bond with X9. In some embodiments, X4 is a 2-methylbenzoyl moiety. In certain embodiments, X4 is selected from Cys, hCys, Pen, and a 2-methylbenzoyl moiety. In certain embodiments, X4 is selected from the group consisting of a modified Ser, a modified hSer, a suitable isostere, and corresponding D-amino acids. In one embodiment, X4 is a hSerCl (before the thioether bond is formed with X9 whereby the Cl is removed) or a hSer precursor (e.g., homoSer(O-TBDMS). In other instances, X4 is an aliphatic acid having from one to four carbons and forming a thioether bond with X9. In some instances, X4 is a five- or six-membered alicyclic acid having a modified 2-methyl group that forms a thioether bond with X9. In some instances, X4 is a 2-methylbenzoyl moiety. In certain embodiments wherein X4 is not an amino acid but is a chemical moiety that binds to X9, X1, X2, and X3 are absent, and X4 is conjugated to or bound to X5. In some embodiments, the amino acid directly carboxyl to X9 is an aromatic amino acid. In certain embodiments, X4 is an amino acid, while in other embodiments, X4 is another chemical moiety capable of binding to X9, e.g., to form a thioether bond. In particular embodiments, X4 is another chemical moiety selected from any of the non-amino acid moieties described herein for X4. In particular embodiments wherein X4 is another chemical moiety, X1, X2 and X3 are absent, and the another chemical moiety is bound to or conjugated to X5. In certain embodiments, X4 is defined as a chemical moiety including a group such as a chloride, e.g., in 2-chloromethylbenzoic acid, 2-chloro-acetic acid, 3-chloropropanoic acid, 4-chlorobutyric acid, 3-chloroisobutyric acid. However, the skilled artisan will appreciate that once the peptide has undergone ring closing cyclization to form a thioether bond between X4 and X9, the chloride group is no longer present. The description of chemical moieties at X4 that include a reactant group such as chloride thus means both the group with the chloride and also the group without the chloride, i.e., after formation of the bond with X9. The present invention also includes peptides comprising the same structure as shown in any of the other formulas or tables described herein, but where the thioether bond is in the reverse orientation. In such embodiments of the invention, it may generally be considered that the amino acid residues or other chemical moieties shown at X4 are instead present at X9, and the amino acid residues shown at X9 are instead present at X4, i.e., the amino acid residue comprising the sulfur of the resulting thioether bond is located at X4 instead of X9, and the amino acid residue or other moiety having a carbon side chain capable of forming a thioether bond with X4 is located at X9. In this reverse orientation, however, the amino acid or chemical moiety at position X9 is one that comprises a free amine. For example, in particular embodiments, the amino acid at X9 is a protected homoserine, such as, e.g., homoserine (OTBDMS). Thus, in particular reverse orientation embodiments of peptide inhibitors of any of the formulas described herein, X9 is an amino acid residue having a side chain with one or two carbons, and forming a thioether bond with X4, and X4 is selected from the group consisting of Cys, N-Me-Cys, D-Cys, HCys, Pen, and D-Pen. Specific examples of amino acid residues and other chemical moieties present at corresponding positions of other formulas and tables are described herein.

One of skill in the art will appreciate that certain amino acids and other chemical moieties are modified when bound to another molecule. For example, an amino acid side chain may be modified when it forms an intramolecular bridge with another amino acid side chain, e.g., one or more hydrogen may be removed or replaced by the bond. In addition, when hSer-Cl binds to an amino acid such as Cys or Pen via a thioether bond, the Cl moiety is released. Accordingly, as used herein, reference to an amino acid or modified amino acid, such as hSer-Cl, present in a peptide dimer of the present invention (e.g., at position X4 or position X9) is meant to include the form of such amino acid or modified amino acid present in the peptide both before and after forming the intramolecular bond.

In certain embodiments, the peptide inhibitor of the peptide inhibitor (or one or both monomer subunits thereof) is cyclized through a triazole ring. In certain embodiments, the peptide inhibitor of the peptide inhibitor (or one or both monomer subunits thereof) is linear or not cyclized. In certain embodiments of any of the peptide inhibitors described herein, including both monomer peptide inhibitors and dimer peptide inhibitors, one (or both) peptide monomer subunits comprise or consist of a cyclized peptide having a structure or sequence set forth in any of Ix, Ia, Ib, Ic, Id, Ie, If, Ig, Ih, Ii, Ij, Ik, Il, Im, In, Io, Ip, Iq, Iq', Ir, Is or It, IIa-IId, IIIa-IIIe, Iva, or IVb.

In certain embodiments of any of the peptide inhibitors or monomer subunits, X7 and X11 are both W.

In certain embodiments of any of the peptide inhibitors or monomer subunits, X7 and X11 are not both W. In particular embodiments, X7 is W and X11 is not W.

In certain embodiments of any of the peptide inhibitors or monomer subunits, X4 and X9 are amino acid residues capable of forming an intramolecular bond between each other that is a thioether bond, a lactam bond, a triazole, a selenoether, a diselenide bond, or an olefin bond.

In certain embodiments, X7 and X11 are both W, X10 is Y, Phe[4-(2-aminoethoxy) or Phe(CONH$_2$), and X4 and X9 are amino acid residues capable of forming an intramolecular bond between each other that is a thioether bond, a lactam bond, a triazole, a selenoether, a diselenide bond, or an olefin bond. In certain embodiments, X7 and X11 are both W, X10 is Y, and X4 and X9 are amino acid residues capable of forming an intramolecular bond between each other that is a thioether bond, a lactam bond, a triazole, a selenoether, a diselenide bond, or an olefin bond.

In certain embodiments, X7 and X11 are both W, X10 is Y, and X4 and X9 are both C.

In certain embodiments, X4 and X9 are each Cys, Pen, hCys, D-Pen, D-Cys or D-hCys, and the intramolecular bond is a disulfide bond.

In certain embodiments, X4 and X9 are each Glu, Asp, Lys, Orn, Dap, Dab, D-Dap, D-Dab, D-Asp, D-Glu or D-Lys, and the intramolecular bond is a lactam bond.

In certain embodiments, X4 and X9 are each β-azido-Ala-OH or propargylglycine, and the peptide inhibitor (or monomer subunit) is cyclized through a triazole ring.

In certain embodiments, X4 and X9 are each 2-allylglycine, 2-(3'-butenyl)glycine, 2-(4'-pentenyl)glycine, or 2-(5'-hexenyl)glycine and the peptide inhibitor (or monomer subunit) is cyclized via ring closing methasis to give the corresponding olefin/"stapled peptide."

In certain embodiments, X4 is 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid, or hSer(Cl); X9 is hSer(Cl), Cys, Pen, hCys, D-Pen, D-Cys or D-hCys; and the intramolecular bond is a thioether bond. In certain embodiments, X4 is 2-chloromethylbenzoic acid or hSer(Cl); X9 is Cys or Pen, and the intramolecular bond is a thioether bond. In certain embodiments, X4 is Abu, and X9 is Cys or Pen.

In certain embodiments, X4 is 2-chloromethylbenzoic acid, 2-chloro-acetic acid, 3-chloro-propanoic acid, 4-chloro-butyric acid, 3-chloro-isobutyric acid, Abu or Sec; X9 is Abu or Sec; and the intramolecular bond is a selenoether bond.

In certain embodiments, the intramolecular bond between X4 and X9 is a diselenide bond.

In certain embodiments of any of the peptide inhibitors described herein that contain two amino acid residues, e.g., cysteine residues, joined by an intramolecular bond, e.g., disulphide bond, the two amino acid residues participating in the intramolecular bond are not both located at either the N-terminal or C-terminal position of the peptide inhibitor. In certain embodiments, neither of the two amino acid residues, e.g., cysteines, participating in the intramolecular bond is located at the N-terminal or C-terminal position of the peptide inhibitor. In other words, in certain embodiments, at least one, or both, of the two amino acid residues, e.g., cysteines, participating in the intramolecular bond are internal amino acid residues of the peptide inhibitor. In certain embodiments, neither of the two amino acid residues, e.g., cysteines, participating in the intramolecular bond is located at the C-terminal position of the peptide inhibitor. At certain embodiment, the two amino acid residues participating in the intramolecular bond are Cys, Pen, hCys, D-Pen, D-Cys or D-hCys residues. In certain embodiments, the two amino acid residues participating in the intramolecular bond are located at X4 and X9. In one embodiment, there is a disulfide bond between the amino acid residues, e.g., cysteines or Pen residues, at X4 and X9.

In particular embodiments of any of the peptide inhibitors described herein, one or both peptide monomer subunits present in the peptide inhibitor, whether it is a monomer or a dimer, is cyclic or cyclized, e.g., by an intramolecular bond, such as a disulfide bond, between two cysteine residues present in the peptide monomer or peptide monomer subunit. In certain embodiments, a peptide inhibitor comprises two or more cysteine residues. In some embodiments, the peptide inhibitor is cyclized via an intramolecular disulfide bond between the two cysteine residues. In particular embodiments of peptide inhibitors having any of the Formulas described herein, the two cysteines occur at positions X4 and X9. In other embodiments, one or both peptide monomer subunits in the peptide inhibitor is cyclized via a disulfide bond between two Pen residues, e.g., at positions X4 and X9.

In some embodiments, a peptide inhibitor has a structure of any of the Formulas described herein (e.g., Formula I and Formula III) and comprises a disulfide bond, e.g., an intramolecular disulfide bond. Illustrative examples of such peptide inhibitors are shown in Tables 3A-3H and 4A, 4B, 9, 11 or 15. Such disulfide bonded peptides may have a particular advantage in that the disulfide bonds enhance structural stability and can improve biological activity of many bioactive peptides. However, in certain situations, these bonds are labile to reducing agents. One of skill in the art will appreciate that disulfide is amenable to simple isosteric replacement. Illustrative examples of such replacements include, but are not limited to, thioethers, dithioethers, selenoethers, diselenides, triazoles, lacatams, alkane and alkene groups. Accordingly, in certain embodiments of any of the peptide inhibitors described herein, one, two or more cysteine residues are substituted, e.g., with a thioether, dithioether, selenoether, diselenide, triazoles, lacatam, alkane or alkene group, including but not limited to any of those shown below or described herein. In particular embodiments, two of these substituted groups form a bond (e.g., an intramolecular bond), thus cyclizing the peptide inhibitor or one or both monomer subunits thereof.

In certain embodiments, a peptide inhibitor of the present invention comprises or consists of an amino acid sequence shown herein, e.g., in any one of Tables 3A-3H, 4A, 4B, 5A-5C, 6, 7, 8, 9, 10, 11, 12, 13, 14 or 15. In certain embodiments, a peptide inhibitor of the present invention has a structure shown herein, e.g., in any one of Tables 3A-3H, 4A, 4B, 5A-5C, 6, 7, 8, 9, 10, 11, 12, 13, 14 or 15.

In certain embodiments, the present invention includes a peptide inhibitor that comprises a core consensus sequence selected from one of the following (shown in N-terminal to C-terminal direction):

$X_1X_2X_2WX_2X_1X_2W$;
$X_1X_2X_2WX_2X_1X_2$ (1-Nal);
$X_1X_2X_2WX_2X_1X_2$ (2-Nal);
$X_1X_2X_2WX_2X_1X_2$;
$X_1X_2X_2WX_2X_1Y$(1-Nal);
$X_1X_2X_2WX_2X_1Y$(2-Nal);
$X_1X_2X_2WX_2X_1X_2X_2$;
$X_1X_2X_2WX_2X_1X_2X_2X_2X_2X_2$-[(D)Lys];
$X_1X_2X_2WX_2X_1X_3X_2$;
$X_1X_2X_2WX_2X_1X_3$(1-Nal); and
$X_1X_2X_2WX_2X_1X_3$(2-Nal).

wherein W is tryptophan, Y is tyrosine, each the two X1 residues are amino acids or other chemical moieties capable of forming an intramolecular bond with each other; each X2 is independently selected from all amino acids, which include, e.g., natural amino acids, L-amino acids, D-amino acids, non-natural amino acids, and unnatural amino acids; and X3 is any amino acid. In particular embodiments, X3 is Phe, a Phe analog (e.g., Phe[4-(2-aminoethoxy)] or Phe(4-CONH$_2$)), Tyr, or a Tyr analog (e.g., Tyr(Me)). In particular embodiments, each X1 is selected from Cys, Pen and Abu. In particular embodiments, each X1 is Cys. In certain embodiments, each X1 is Pen. In certain embodiments, one X1 is Cys and the other X1 is Abu. In particular embodiments, the N-terminal X1 is Abu and the C-terminal X1 is Cys. In particular embodiments, the N-terminal X1 is Cys and the C-terminal X1 is Abu. In particular embodiments, the residues between the two X1 residues are Gln, Thr, Trp and Gln. In particular embodiments, each X1 is selected from Cys, Pen and Abu; and X3 is Phe, a Phe analog (e.g., Phe[4-(2-aminoethoxy)] or Phe(4-carbomide)), Tyr, or a Tyr analog (e.g., Tyr(Me)). In particular embodiments, X3 is a Phe analog.

In certain embodiments, peptide inhibitors of the present invention comprises any of the following consensus sequences, wherein X1, X2, X3, X4, X5, X6, X7, X8, X9, X10, X11, X12, X13, X14 and X15 are defined as shown in any of the various Formula or peptide inhibitors described herein:

X1-X2-X3-Pen-X5-X6-W-X8-Pen-X10-X11-X12-X13-X14-X15;
Pen-X5-X6-W-Q-Pen;
Pen-X5-X6-W-X8-Pen;
Pen-X5-X6-W-X8-Pen-[Phe(4-CONH2)];
Pen-X5-X6-W-X8-Pen-[Phe(4-(2-aminoethoxy)]];
X1-X2-X3-Abu-X5-X6-W-X8-C-X9-X10-X11-X12-X13-X14-X15;
Abu-X5-X6-W-Q-C;
Abu-X5-X6-W-X8-C;
Abu-X5-X6-W-X8-C-[Phe(4-CONH2)]; or
Abu-X5-X6-W-X8-C-[Phe(4-(2-aminoethoxy)]].

In certain embodiments of any of the peptide inhibitors or monomer subunits, X7 and X11 are both W. In certain embodiments of any of the peptide inhibitors, X7 and X11 are both W, and X10 is Y. In certain embodiments, X7 and X11 are both W and X10 is Phe[4-(2-aminoethoxy)] or Phe(4-OMe).

In certain embodiments of any of the peptide inhibitors or monomer subunits, X7 and X11 are not both W.

In certain embodiments of peptide inhibitors of Formula I, X4 and X9 are each Pen, and the intramolecular bond is a disulfide bond.

In certain embodiments, a peptide inhibitor of the present invention comprises or consists of an amino acid sequence shown in any one of the tables or the accompanying figures herein. In certain embodiments, a peptide inhibitor of the present invention has a structure shown in any one of Tables 3A-3H, 4A, 4B, 5A-5C, or 6-14.

In certain embodiments of any of the peptide inhibitors described herein that contain two amino acid residues, e.g., Pen residues, joined by an intramolecular bond, e.g., disulphide bond, one or both of the two amino acid residues participating in the intramolecular bond are not located at either the N-terminal or C-terminal position of the peptide inhibitor. In certain embodiments, neither of the two amino acid residues, e.g., Pen, participating in the intramolecular bond is located at the N-terminal or C-terminal position of the peptide inhibitor. In other words, in certain embodiments, at least one, or both, of the two amino acid residues, e.g., Pens, participating in the intramolecular bond are internal amino acid residues of the peptide inhibitor. In certain embodiments, neither of the two amino acid residues, e.g., Pens, participating in the intramolecular bond is located at the C-terminal position of the peptide inhibitor.

In some embodiments, wherein a peptide of the invention is conjugated to an acidic compound such as, e.g., isovaleric acid, isobutyric acid, valeric acid, and the like, the presence of such a conjugation is referenced in the acid form. So, for example, but not to be limited in any way, instead of indicating a conjugation of isovaleric acid to a peptide by referencing isovaleroyl (e.g., isovaleroyl-[Pen]-QTWQ [Pen]-[Phe(4-OMe)]-[2-Nal]-[α-MeLys]-[Lys(Ac)]-NG-NH$_2$ (SEQ ID NO: 262) in some embodiments, the present application references such a conjugation as isovaleric acid-[Pen]-QTWQ[Pen]-[Phe(4-OMe)]-[2-Nal]-[α-MeLys]-[Lys (Ac)]-NG-NH$_2$ (SEQ ID NO: 263).

The present invention further includes peptide inhibitors that selectively bind to an epitope or binding domain present within amino acid residues 230-349 of the human IL23R protein. In particular embodiments, the peptide inhibitor binds human IL23R and not mouse IL-23R. In certain embodiments, the peptide inhibitor also binds to rat IL-23R.

In certain embodiments of peptide inhibitors of Formula I, X4 is Abu; X9 is Cys, Pen, homocys, and the intramolecular bond is a thioether bond.

In certain embodiments of Formula I, X4 is Cys, Pen, hCys, D-Pen, D-Cys or D-hCys; X9 is Abu; and the intramolecular bond is a thioether bond.

Illustrative Peptide Inhibitors Comprising Pen-Pen Disulfide Bonds

In certain embodiments, the present invention includes a peptide inhibitor of an interleukin-23 receptor, wherein the peptide inhibitor has the structure of Formula II:

or a pharmaceutically acceptable salt or solvate thereof, wherein R$^1$ is a bond, hydrogen, a C1-C6 alkyl, a C6-C12 aryl, a C6-C12 aryl, a C1-C6 alkyl, a C1-C20 alkanoyl, an alkylsulphonate, an acid, γ-Glu or pGlu, appended to the N-terminus, and including PEGylated versions (e.g., 200 Da to 60,000 Da), alone or as a spacer of any of the foregoing;
R$^2$ is a bond, OH or NH$_2$; and
X is an amino acid sequence of 8 to 20 amino acids or 8 to 35 amino acids.

In particular embodiments of peptide inhibitor of Formula II, X comprises or consists of the sequence of Formula IIa:

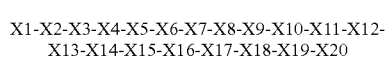

wherein
X1 is absent or any amino acid;
X2 is absent or any amino acid;
X3 is absent or any amino acid;
X4 is Pen, Cys or homo-Cys;
X5 is any amino acid;
X6 is any amino acid;
X7 is Trp, Bip, Gln, His, Glu(Bzl), 4-Phenylbenzylalanine, Tic, Phe[4-(2-aminoethoxy)], Phe(3,4-Cl$_2$), Phe(4-OMe), 5-Hydroxy-Trp, 6-Chloro-Trp, N-MeTrp, α-Me-Trp, 1,2,3,4-tetrahydro-norharman, Phe(4-CO$_2$H), Phe(4-CONH$_2$), Phe(3,4-Dimethoxy), Phe(4-CF$_3$), Phe(4-tBu), ββ-diPheAla, Glu, Gly, Ile, Asn, Pro, Arg, Thr or Octgly, or a corresponding α-methyl amino acid form of any of the foregoing;
X8 is any amino acid;
X9 is Pen, Cys or hCys;
X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly, a Phe analog or a Tyr analog (optionally, Phe(3,4-F$_2$), Phe(3,4-Cl$_2$), F(3-Me), Phe[4-(2-aminoethoxy)], Phe[4-(2-(acetyl-aminoethoxy)], Phe(4-Br), Phe(4-CONH$_2$), Phe(4-Cl), Phe (4-CN), Phe(4-guanidino), Phe(4-Me), Phe(4-NH$_2$), Phe(4-N$_3$), Phe(4-OMe), or Phe(4-OBzl)), or a corresponding α-methyl amino acid form of any of the foregoing;
X11 is 2-Nal, 1-Nal, 2,4-dimethylPhe, Bip, Phe(3,4-Cl$_2$), Phe(3,4-F$_2$), Phe(4-CO$_2$H), βhPhe(4-F), α-Me-Trp, 4-phenylcyclohexyl, Phe(4-CF$_3$), α-MePhe, βhNal, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino, Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe(4-CONH$_2$), Phe(3,4-OMe$_2$) Phe(2,3-Cl$_2$), Phe(2,3-F$_2$), Phe(4-F), 4-phenylcyclohexylalanine or Bip, or a corresponding α-methyl amino acid form of any of the foregoing;
X12 is α-MeLys, α-MeOrn, α-MeLeu, α-MeVal, 4-amino-4-carboxy-tetrahydropyran, Achc Acpc, Acbc, Acvc, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing;
X13 is Lys(Ac), (D)Asn, (D)Leu, (D)Thr, (D)Phe, Ala, Aib, α-MeLeu, β-Ala, βhGlu, βhAla, βhLeu, βhVal, β-spiro-pip, Cha, Chg, Asp, Lys, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing;
X14 is Asn, Glu, Phe, Gly, His, Lys, Leu, Met, Asn, Pro, Gln, Arg, Ser, Thr, Tic or Tyr, Lys(Ac), Orn or a corresponding α-methyl amino acid form of any of the foregoing;
X15 is Gly, (D)Ala, (D)Asn, (D)Asp, Asn, (D)Leu, (D)Phe, (D)Thr, Ala, AEA, Asp, Glu, Phe, Gly, Lys, Leu, Pro, Gln, Arg or Ser, β-Ala, Arg or a corresponding α-methyl amino acid form of any of the foregoing;
X16 is absent, Gly, Ala, Asp, Ser, Pro, Asn or Thr, or a corresponding α-methyl amino acid form of any of the foregoing;
X17 is absent, Glu, Ser, Gly or Gln, or a corresponding α-methyl amino acid form of any of the foregoing;
X18 is absent or any amino acid;
X19 is absent or any amino acid; and
X20 is absent or any amino acid.

In certain embodiments of IIa: X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly, a Phe analog or a Tyr analog, or a corresponding α-methyl amino acid form of any of the foregoing; X11 is 2-Nal, 1-Nal, 2,4-dimethylPhe, Bip, Phe (3,4-Cl$_2$), Phe(3,4-F$_2$), Phe(4-CO$_2$H), βhPhe(4-F), α-Me-Trp, 4-phenylcyclohexyl, Phe(4-CF$_3$), α-MePhe, βhNal, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino, Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe(4-CONH$_2$), Phe(3,4-Dimethoxy), Phe(2,3-Cl$_2$), Phe(2,3-F$_2$), Phe(4-F), 4-phenylcyclohexylalanine or Bip, or a corresponding α-methyl amino acid form of any of the foregoing;
X12 is α-MeLys, α-MeOrn, α-MeLeu, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing; X13 is Lys(Ac), (D)Asn, (D)Leu, (D)Thr, (D)Phe, Ala, Aib, α-MeLeu, β-Ala, βhGlu, βhAla, βhLeu, βhVal, β-spiro-pip, Cha, Chg, Asp, Lys, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing;

X14 is Asn, Glu, Phe, Gly, His, Lys, Leu, Met, Asn, Pro, Gln, Arg, Ser, Thr, Tic or Tyr, or a corresponding α-methyl amino acid form of any of the foregoing; and X15 is Gly, (D)Ala, (D)Asn, (D)Asp, Asn, (D)Leu, (D)Phe, (D)Thr, Ala, AEA, Asp, Glu, Phe, Gly, Lys, Leu, Pro, Gln, Arg or Ser, or a corresponding α-methyl amino acid form of any of the foregoing.

In certain embodiments, X3 is present. In particular embodiments, X3 is Glu, (D)Glu, Arg, (D)Arg, Phe, (D)Phe, 2-Nal, Thr, Leu, (D)Gln. In certain embodiments, X3 is (D)Arg or (D)Phe. In particular embodiments, X1 and X2 are absent and X3 is present.

In certain embodiments, X5 is Gln, Ala, Cit, Asp, Dab, Dap, Cit Glu, Phe, Gly, His, hCys, Lys, Leu, Met, Asn, N-Me-Ala, N-Me-Asn, N-Me-Lys, α-Me-Lys, α-Me-Orn, N-Me-Gln, N-Me-Arg, α-MeSer, Orn, Pro, Arg, Ser, Thr, or Val. In certain embodiments, X5 is Gln, Ala, Cit, Asp, Dab, Dap, Glu, Phe, Gly, His, hCys, Lys, Leu, Met, Asn, N-Me-Ala, N-Me-Asn, N-Me-Lys, αMe-Lys, αMe-Orn, N-Me-Gln, N-Me-Arg, Orn, Pro, Arg, Ser, Thr, or Val. In certain embodiments, X5 is Gln or Asn.

In certain embodiments, X6 is Thr, Asp, Glu, Phe, Asn, Pro, Arg, or Ser.

In certain embodiments, X7 is Trp.

In certain embodiments, X8 is Gln, Glu, Phe, Lys, Asn, Pro, Arg, Val, Thr, or Trp.

In certain embodiments, X10 is a Tyr analog or a Phe analog. In particular embodiments, X10 is a Phe analog.

In certain embodiments wherein X10 is a Phe analog, X10 is selected from hPhe, Phe(4-OMe), α-Me-Phe, hPhe(3,4-dimethoxy), Phe(4-CONH$_2$), Phe(4-phenoxy), Phe(4-guanadino), Phe(4-tBu), Phe(4-CN), Phe(4-Br), Phe(4-OBzl), Phe(4-NH$_2$), Phe(4-F), Phe(3,5 DiF), Phe(CH$_2$CO$_2$H), Phe (penta-F), Phe(3,4-Cl$_2$), Phe(4-CF$_3$), ββ-diPheAla, Phe(4-N$_3$) and Phe[4-(2-aminoethoxy)]. In particular embodiments, X10 is Phe(4-OMe) or Phe[4-(2-aminoethoxy)]. In particular embodiments, X10 is Phe(4-OMe), Phe(4-CONH$_2$) or Phe[4-(2-aminoethoxy)]. In certain embodiments where X10 wherein X10 is a Phe analog, X10 is selected from hPhe, Phe(4-OMe), α-Me-Phe, hPhe(3,4-dimethoxy), Phe(4-CONH$_2$), Phe(4-phenoxy), Phe(4-guanadino), Phe(4-tBu), Phe(4-CN), Phe(4-Br), Phe(4-OBzl), Phe(4-NH$_2$), Phe(4-F), Phe(3,5 DiF), Phe(CH$_2$CO$_2$H), Phe (penta-F), Phe(3,4-Cl$_2$), Phe(4-CF$_3$), ββ-diPheAla, Phe(4-N$_3$) and Phe[4-(2-aminoethoxy)]. In particular embodiments, X10 is Phe(4-OMe).

In certain embodiments where X10 is a Tyr analog, X10 is selected from hTyr, α-MeTyr, N-Me-Tyr, Tyr(3-tBu), Phe(4-CONH$_2$), Phe[4-(2-aminoethoxy)], and bhTyr. In certain embodiments where X10 is a Tyr analog, X10 is selected from hTyr, α-MeTyr, N-Me-Tyr, Tyr(3-tBu), and bhTyr.

In certain embodiments, X10 is Tyr, Phe(4-OMe), Phe[4-(2-aminoethoxy)], Phe(4-CONH$_2$), or 2-Nal. In certain embodiments, X10 is Phe(4-OMe) or Phe[4-(2-aminoethoxy)]. In certain embodiments, X10 is not Tyr.

In certain embodiments, X11 is a Trp analog. In particular embodiments, X11 is 2-Nal or 1-Nal. In certain embodiments, X11 is 2-Nal.

In certain embodiments, X12 is Aib, α-MeLys or α-MeLeu.

In particular embodiments of a peptide inhibitor of Formula II, one or both of X4 or X9 is Pen. In particular embodiments, both X4 and X9 are Pen.

In certain embodiments, the peptide inhibitor of Formula II is cyclized. In particular embodiments, the peptide inhibitor of Formula II is cyclized via an intramolecular bond between X4 and X9. In particular embodiments, the intramolecular bond is a disulfide bond. In particular embodiments, X4 and X9 are both Pen.

In certain embodiments, the peptide inhibitor of Formula II is linear or not cyclized. In particular embodiments of the linear peptide inhibitor of Formula I, X4 and/or X9 are any amino acid.

In particular embodiments of a peptide inhibitor of Formula II, one or more, two or more, or all three of X1, X2, and X3 are absent. In certain embodiments, X1 is absent. In certain embodiments, X1 and X2 are absent. In certain embodiments, X1, X2 and X3 are absent.

In particular embodiments of a peptide inhibitor of Formula II, one or more, two or more, three or more, four or more, or all of X16, X17, X18, X19 and X20 are absent. In particular embodiments of a peptide inhibitor of Formula I, one or more, two or more, three or more, or all of X17, X18, X19 and X20 are absent. In certain embodiments, one or more, two or more, or all three of X17, X19 and X20 are absent. In certain embodiments, one or more of X1, X2 and X3 are absent; and one or more, two or more, three or more, or four of X17, X18, X19 and X20 are absent.

In particular embodiments of a peptide inhibitor of Formula II, X18 is (D)-Lys. In certain embodiments, X18 is (D)-Lys and X17 is absent.

In particular embodiments of a peptide inhibitor of Formula II, the peptide inhibitor comprises one or more, two or more, three or more, or four of the following features: X5 is Asn, Arg or Gln; X6 is Thr; X7 is Trp; and X8 is Gln. In particular embodiments of a peptide inhibitor of Formula I, X4 is Pen; X5 is Gln, Asn or Arg; X6 is Thr; X7 is Trp, 5-hydroxy-Trp, 6-chloro-Trp, N-MeTrp, alpha-Me-Trp, or 1,2,3,4-tetrahydro-norharman; X8 is Gln; and X9 is Pen. In particular embodiments, X5 is Gln. In certain embodiments, X1, X2 and X3 are absent. In particular embodiments, both X4 and X9 are Pen.

In particular embodiments of a peptide inhibitor of Formula II, the peptide inhibitor comprises one or more, two or more, three or more, four or more, five or more, six or more, or seven of the following features: X10 is Tyr, a Phe analog, a Tyr analog or 2-Nal; X11 is Trp, 5-hydroxy-Trp, 6-chloro-Trp, N-MeTrp, alpha-Me-Trp, 1,2,3,4-tetrahydro-norharman, 2-Nal or 1-Nal; X12 is Aib, α-MeLys, α-MeOrn and α-MeLeu; X13 is Lys, Glu or Lys(Ac); X14 is Phe or Asn; X15 is Gly, Ser or Ala; and X16 is absent or AEA. In certain embodiments, X10 is Tyr, Phe(4-OMe), Phe[4-(2-aminoethoxy)], Phe(CONH$_2$), or 2-Nal. In certain embodiments, X11 is 2-Nal or 1-Nal. In certain embodiments, X10 is not Tyr. In certain embodiments, X1, X2 and X3 are absent. In particular embodiments, both X4 and X9 are Pen.

In particular embodiments of a peptide inhibitor of Formula II, the peptide inhibitor comprises one or more, two or more, three or more, four or more, five or more, six or more, seven or more, eight or more, nine or more, ten or more, or eleven of the following features: X5 is Arg or Gln; X6 is Thr; X7 is Trp; X8 is Gln; X10 is a Phe analog; X11 is Trp, 2-Nal or 1-Nal;

X12 is Aib, α-MeLys or α-MeOrn; X13 is Lys, Glu or Lys(Ac); X14 is Asn; X15 is Gly, Ser or Ala; and X16 is absent or AEA. In certain embodiments, X10 is Phe(4-OMe) or Phe[4-(2-aminoethoxy)]. In certain embodiments, X11 is 2-Nal or 1-Nal. In certain embodiments, X1, X2 and X3 are absent. In particular embodiments, both X4 and X9 are Pen.

In particular embodiments of a peptide inhibitor of Formula II, the peptide is cyclized via X4 and X9; X4 and X9 are Pen; X5 is Gln; X6 is Thr; X7 is Trp; X8 is Gln; X10 is Tyr, a Phe analog or 2-Nal; X11 is Trp, 2-Nal or 1-Nal; X12 is Arg, α-MeLys, α-MeOrn, or α-MeLeu; X13 is Lys, Glu or Lys(Ac); X14 is Phe or Asn; X15 is Gly, Ser or Ala; and X16 is absent. In certain embodiments, X10 is Tyr, Phe(4-OMe), Phe[4-(2-aminoethoxy)], Phe(4-OMe) or 2-Nal. In certain embodiments, X10 is Phe(4-OMe). In certain embodiments, X10 is not Tyr. In certain embodiments, X11 is 2-Nal or 1-Nal. In certain embodiments, X1, X2 and X3 are absent.

In particular embodiments of a peptide inhibitor of Formula II, the peptide is cyclized via X4 and X9; X4 and X9 are Pen; X5 is Gln; X6 is Thr; X7 is Trp; X8 is Gln; X10 is Tyr, Phe(4-OMe) or 2-Nal; X11 is Trp, 2-Nal or 1-Nal; X12 is Arg, α-MeLys or α-MeOrn; X13 is Lys, Glu or Lys(Ac); X14 is Phe or Asn; X15 is Gly; and X16 is absent. In certain embodiments, X10 is Phe(4-OMe). In certain embodiments, X11 is 2-Nal or 1-Nal. In certain embodiments, X1, X2 and X3 are absent.

In particular embodiments of a peptide inhibitor of Formula II, the peptide is cyclized via X4 and X9; X4 and X9 are Pen; X5 is Gln; X6 is Thr; X7 is Trp; X8 is Gln; X10 is Phe(4-OMe) or Phe[4-(2-aminoethoxy)]; X11 is Trp, 2-Nal or 1-Nal; X12 is α-MeLys, α-MeOrn, or α-MeLeu; X13 is Lys, Glu or Lys(Ac); X14 is Asn; X15 is Gly, Ser or Ala; and X16 is absent. In certain embodiments, X10 is Phe(4-OMe). In certain embodiments, X11 is 2-Nal or 1-Nal. In certain embodiments, X1, X2 and X3 are absent.

In particular embodiments of a peptide inhibitor of Formula II, X10 is not Tyr.

In certain embodiments, the present invention includes a peptide, optionally 8 to 35, 8 to 20, 8 to 16 or 8 to 12 amino acids in length, optionally cyclized, comprising or consisting of having a core sequence of Formula IIb:

Pen-Xaa5-Xaa6-Trp-Xaa8-Pen-Xaa10-[(2-Nal)]    (IIb)

wherein Xaa5, Xaa6 and Xaa8 are any amino acid residue; and Xaa10 is a Phe analogue, wherein the peptide inhibits binding of IL-23 to IL-23R. In particular embodiments, X10 is a Phe analog selected from α-Me-Phe, Phe(4-OMe), Phe(4-OBzl), Phe(4-OMe), Phe(4-CONH$_2$), Phe(3,4-Cl$_2$), Phe(4-tBu), Phe(4-NH$_2$), Phe(4-Br), Phe(4-CN), Phe(4-CO$_2$H), Phe[4-(2-aminoethoxy)] or Phe(4-guanadino). In particular embodiments, Xaa10 is Phe(4-OMe) or Phe[4-(2-aminoethoxy)]. In one embodiment, Xaa10 is Phe(4-OMe). In certain embodiments, the peptide is cyclized via an intramolecular bond between Pen at Xaa4 and Pen at Xaa9. In particular embodiments, the peptide is a peptide inhibitor of Formula II, and wherein in certain embodiments, X1, X2 and X3 are absent. In particular embodiments, the peptide inhibits the binding of IL-23 to IL-23R. In certain embodiments, a peptide of Formula IIb further comprises an amino acid bound to the N-terminal Pen residue. In particular embodiments, the bound amino acid is Glu, (D)Glu, Arg, (D)Arg, Phe, (D)Phe, 2-Nal, Thr, Leu, or (D)Gln. In certain embodiments, it is (D)Arg or (D)Phe.

In certain embodiments, the present invention includes a peptide, optionally 8 to 35, 8 to 20, 8 to 16, or 8 to 12 amino acids in length, optionally cyclized, comprising or consisting of a core sequence of Formula IIc:

Pen-Xaa5-Xaa6-Trp-Xaa8-Pen-Xaa10-[(2-Nal)]    (IIc)

wherein Xaa5, Xaa6 and Xaa8 are any amino acid residue; and Xaa10 is Tyr, a Phe analog, α-Me-Tyr, α-Me-Trp or 2-Nal, wherein the peptide inhibits binding of IL-23 to IL-23R. In certain embodiments, X10 is Tyr, Phe(4-OMe), Phe[4-(2-aminoethoxy)], α-Me-Tyr, α-Me-Phe, α-Me-Trp or 2-Nal. In certain embodiments, Xaa10 is Tyr, Phe(4-OMe), Phe(CONH$_2$), Phe[4-(2-aminoethoxy)] or 2-Nal. In certain embodiments, Xaa10 is Tyr, Phe(4-OMe), Phe[4-(2-aminoethoxy)] or 2-Nal. In particular embodiments, Xaa10 is Phe(4-OMe) or Phe[4-(2-aminoethoxy)]. In one embodiment, Xaa10 is Phe[4-(2-aminoethoxy)] or Phe(CONH$_2$). In particular embodiments, Xaa10 is Phe(4-OMe) or Phe[4-(2-aminoethoxy)]. In one embodiment, Xaa10 is Phe[4-(2-aminoethoxy)]. In certain embodiments, Xaa10 is not Tyr. In certain embodiments, the peptide is cyclized via an intramolecular bond between Pen at Xaa4 and Pen at Xaa9. In particular embodiments, the peptide is a peptide inhibitor of Formula II, and wherein in certain embodiments, X1, X2 and X3 are absent. In particular embodiments, the peptide inhibits the binding of IL-23 to IL-23R. In certain embodiments, a peptide of Formula IIc further comprises an amino acid bound to the N-terminal Pen residue. In particular embodiments, the bound amino acid is Glu, (D)Glu, Arg, (D)Arg, Phe, (D)Phe, 2-Nal, Thr, Leu, or (D)Gln. In certain embodiments, it is (D)Arg or (D)Phe.

In certain embodiments, the present invention includes a peptide, optionally 8 to 35, 8 to 20, 8 to 16 or 8 to 12 amino acids in length, optionally cyclized, comprising or consisting of a core sequence of Formula IId:

Pen-Xaa5-Xaa6-Trp-Xaa8-Pen-Phe[4-(2-aminoethoxy)]-[2-Nal]    (IId)

wherein Xaa5, Xaa6 and Xaa8 are any amino acid residue. In certain embodiments, the peptide comprises a disulfide bond between Xaa4 and Xaa9. In certain embodiments, the peptide is a peptide inhibitor of Formula I, and wherein in certain embodiments, X1, X2 and X3 are absent. In particular embodiments, the peptide inhibits the binding of IL-23 to IL-23R. In certain embodiments, a peptide of Formula IId further comprises an amino acid bound to the N-terminal Pen residue. In particular embodiments, the bound amino acid is Glu, (D)Glu, Arg, (D)Arg, Phe, (D)Phe, 2-Nal, Thr, Leu, or (D)Gln. In certain embodiments, it is (D)Arg or (D)Phe.

In particular embodiments of a peptide inhibitor of Formula II, the peptide inhibitor has a structure shown in any of Tables 4A, 4B, 8, 11 or 15 or comprises an amino acid sequence set forth in Tables 4A, 4B, 8, 11 or 15.

Illustrative Peptide Inhibitors Comprising Thioether Bonds

In certain embodiments, the present invention includes a peptide inhibitor of an interleukin-23 receptor, wherein the peptide inhibitor has the structure of Formula III:

R$^1$—X—R$^2$    (III)

or a pharmaceutically acceptable salt or solvate thereof, wherein R$^1$ is a bond, hydrogen, a C1-C6 alkyl, a C6-C12 aryl, a C6-C12 aryl, a C1-C6 alkyl, a C1-C20 alkanoyl, an alkylsulphonate, an acid, γ-Glu or pGlu, appended to the N-terminus, and including PEGylated versions (e.g., 200 Da to 60,000 Da), alone or as a spacer of any of the foregoing;

$R^2$ is a bond, OH or $NH_2$; and

X is an amino acid sequence of 8 to 20 amino acids or 8 to 35 amino acids,

In particular embodiments of peptide inhibitors of Formula III, X comprises or consists of the sequence of Formula IIIa:

X1-X2-X3-X4-X5-X6-X7-X8-X9-X10-X11-X12-X13-X14-X15-X16-X17-X18-X19-X20  (IIIa)

wherein

X1 is absent or any amino acid;

X2 is absent or any amino acid;

X3 is absent or any amino acid;

X4 is Abu, Pen, or Cys;

X5 is any amino acid;

X6 is any amino acid;

X7 is Trp, Bip, Gln, His, Glu(Bzl), 4-Phenylbenzylalanine, Tic, Phe[4-(2-aminoethoxy)], Phe(3,4-Cl$_2$), Phe(4-OMe), 5-Hydroxy-Trp, 6-Chloro-Trp, N-MeTrp, α-MeTrp, 1,2,3,4-tetrahydro-norharman, Phe(4-CO$_2$H), Phe(4-CONH$_2$), Phe(3,4-(OCH$_3$)$_2$), Phe(4-CF$_3$), ββ-diPheAla, Phe(4-tBu), Glu, Gly, Ile, Asn, Pro, Arg, Thr or Octgly, or a corresponding α-methyl amino acid form of any of the foregoing;

X8 is any amino acid;

X9 is Abu, Pen, or Cys;

X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly a Phe analog or a Tyr analog (optionally, Phe(3,4-F$_2$), Phe(3,4-Cl$_2$), F(3-Me), Phe[4-(2-aminoethoxy)], Phe[4-(2-(acetylaminoethoxy)], Phe(4-Br), Phe(4-CONH$_2$), Phe(4-Cl), Phe (4-CN), Phe(4-guanidino), Phe(4-Me), Phe(4-NH$_2$), Phe(4-N$_3$), Phe(4-OMe), Phe(4-OBzl)), or a corresponding α-methyl amino acid form of any of the foregoing;

X11 is 2-Nal, 1-Nal, 2,4-dimethylPhe, Bip, 4-phenylcyclohexyl, Glu(Bzl), 4-Phenylbenzylalanine, Tic, Phe[4-(2-aminoethoxy)], Phe(3,4-Cl$_2$), Phe(3,4-F$_2$), βhPhe(4-F), Phe(4-OMe), 5-Hydroxy-Trp, 6-Chloro-Trp, N-MeTrp, α-MeTrp, 1,2,3,4-tetrahydro-norharman, Phe(4-CO$_2$H), Phe(4-CONH$_2$), Phe(3,4-Dimethoxy), Phe(4-CF$_3$), Phe(2,3-Cl$_2$), Phe(3,4-Cl$_2$), Phe(2,3-F$_2$), Phe(4-F), 4-phenylcyclohexylalanine, α-MePhe, βhNal, βhPhe, βhTyr, βhTrp, Bip, Nva(5-phenyl), Phe, His, hPhe, Tqa, Trp, Tyr, Phe(4-Me), Trp(2,5,7-tri-tertButyl), Phe(4-OAllyl), Tyr(3-tBu), Phe(4-tBu), Phe(4-guanidino), Phe(4-OBzl), or Octgly, or a corresponding α-methyl amino acid form of any of the foregoing;

X12 is α-MeLys, α-MeOrn, α-MeLeu, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, amino-4-carboxy-tetrahydropyran, Achc Acpc, Acbc, Acvc, Aib, or a corresponding α-methyl amino acid form of any of the foregoing;

X13 is Lys Lys(Ac), (D)Asn, (D)Leu, (D)Thr, (D)Phe, Ala, Aib, α-MeLeu, βAla, βhGlu, βhAla, βhLeu, βhVal, β-spiropip, Cha, Chg, Asp, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing;

X14 is Asn, Glu, Phe, Gly, His, Lys, Lys (Ac), Leu, Met, Asn, Pro, Gln, Arg, Ser, Thr, Tic or Tyr, or a corresponding α-methyl amino acid form of any of the foregoing;

X15 is Gly, (D)Ala, (D)Asn, (D)Asp, Asn, (D)Leu, (D)Phe, (D)Thr, Ala, AEA, Asp, Glu, Phe, Gly, Lys, Leu, Pro, Gln, Arg, β-Ala, or Ser, or a corresponding α-methyl amino acid form of any of the foregoing;

X16 is absent, Gly, Ala, Asp, Ser, Pro, Asn or Thr, or a corresponding α-methyl amino acid form of any of the foregoing;

X17 is absent, Glu, Ser, Gly or Gln, or a corresponding α-methyl amino acid form of any of the foregoing;

X18 is absent or any amino acid;

X19 is absent or any amino acid; and

X20 is absent or any amino acid.

In certain embodiments of IIIa: X7 is Trp, Bip, Gln, His, Glu(Bzl), 4-Phenylbenzylalanine, Tic, Phe[4-(2-aminoethoxy)], Phe(3,4-Cl$_2$), Phe(4-OMe), 5-Hydroxy-Trp, 6-Chloro-Trp, N-MeTrp, α-MeTrp, 1,2,3,4-tetrahydro-norharman, Phe(4-CO$_2$H), Phe(4-CONH$_2$), Phe(3,4-Dimethoxy), Phe(4-CF$_3$), ββ-diPheAla, Phe(4-tBu), Glu, Gly, Ile, Asn, Pro, Arg, Thr or Octgly, or a corresponding α-methyl amino acid form of any of the foregoing; X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly a Phe analog or a Tyr analog, or a corresponding α-methyl amino acid form of any of the foregoing; X11 is 2-Nal, 1-Nal, 2,4-dimethylPhe, Bip, 4-phenylcyclohexyl, Glu(Bzl), 4-Phenylbenzylalanine, Tic, Phe[4-(2-aminoethoxy)], Phe(3,4-Cl$_2$), Phe(3,4-F$_2$), βhPhe (4-F), Phe(4-OMe), 5-Hydroxy-Trp, 6-Chloro-Trp, N-MeTrp, α-MeTrp, 1,2,3,4-tetrahydro-norharman, Phe(4-CO$_2$H), Phe(4-CONH$_2$), Phe(3,4-Dimethoxy), Phe(4-CF$_3$), Phe(2,3-Cl$_2$), Phe(2,3-F$_2$), Phe(4-F), 4-phenylcyclohexylalanine, α-MePhe, βhNal, βhPhe, βhTyr, βhTrp, Bip, Nva (5-phenyl), Phe, His, hPhe, Tqa, Trp, Tyr, Phe(4-Me), Trp (2,5,7-tri-tertButyl), Phe(4-OAllyl), Tyr(3-tBu), Phe(4-tBu), Phe(4-guanidino), Phe(4-OBzl), or Octgly, or a corresponding α-methyl amino acid form of any of the foregoing; X12 is α-MeLys, α-MeOrn, α-MeLeu, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing; X13 is Lys(Ac), (D)Asn, (D)Leu, (D)Thr, (D)Phe, Ala, Aib, α-MeLeu, βAla, βhGlu, βhAla, βhLeu, βhVal, β-spiro-pip, Cha, Chg, Asp, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing; X14 is Asn, Glu, Phe, Gly, His, Lys, Leu, Met, Asn, Pro, Gln, Arg, Ser, Thr, Tic or Tyr, or a corresponding α-methyl amino acid form of any of the foregoing; and X15 is Gly, (D)Ala, (D)Asn, (D)Asp, Asn, (D)Leu, (D)Phe, (D)Thr, Ala, AEA, Asp, Glu, Phe, Gly, Lys, Leu, Pro, Gln, Arg or Ser, or a corresponding α-methyl amino acid form of any of the foregoing.

In certain embodiments, X3 is present. In particular embodiments, X3 is Glu, (D)Glu, Arg, (D)Arg, Phe, (D)Phe, 2-Nal, Thr, Leu, or (D)Gln. In certain embodiments, it is (D)Arg or (D)Phe.

In particular embodiments, X5 is Gln, Ala, Cys, Cit, Asp, Dab, Dap, Glu, Phe, Gly, His, hCys, Lys, Leu, Met, Asn, N-Me-Ala, N-M-Asn, N-Me-Lys, N-Me-Gln, N-Me-Arg, Orn, Pro, Pen, Gln, Arg, Ser, Thr, or Val.

In particular embodiments, X6 is Thr, Asp, Glu, Phe, Asn, Pro, Arg, Ser, or Thr.

In particular embodiments, X8 is Gln, Glu, Phe, Lys, Asn, Pro, Arg, Val, Thr, or Trp.

In certain embodiments, X10 is a Tyr analog or a Phe analog. In particular embodiments, X10 is Phe(4-OMe), Phe(CONH$_2$) or Phe[4-(2-aminoethoxy)]. In certain embodiments, X10 is a Tyr analog or a Phe analog. In particular embodiments, X10 is Phe(4-OMe) or Phe[4-(2-aminoethoxy)].

In certain embodiments where X10 is a the Phe analog, X10 is selected from hPhe, Phe(4-OMe), α-MePhe, hPhe (3,4-dimethoxy), Phe(4-CONH$_2$), Phe(4-O-Bzl)), Phe(4-guanadino), Phe(4-tBu), Phe(4-CN), Phe(4-Br), Phe(4-NH$_2$), Phe(4-F), Phe(3,5 DiF), Phe(CH$_2$CO$_2$H), Phe(penta-F), Phe(3,4-Cl$_2$), Phe(4-CF3), ββ-diPheAla, Phe(4-N$_3$) and Phe[4-(2-aminoethoxy)]. In particular embodiments, X10 is Phe[4-(2-aminoethoxy)] or Phe(CONH$_2$). In particular embodiments, X10 is Phe[4-(2-aminoethoxy)].

In certain embodiments where X10 is a Tyr analog, X10 is selected from hTyr, N-Me-Tyr, Tyr(3-tBu), Phe(4-OMe) and bhTyr. In particular embodiments, X10 is Phe(4-OMe).

In particular embodiments, X10 is Tyr, Phe(4-OMe), Phe(4-OBzl), Phe(4-OMe), Phe(4-CONH$_2$), Phe(3,4-Cl$_2$), Phe(4-tBu), Phe(4-NH2), Phe(4-Br), Phe(4-CN), Phe(4-carboxy), Phe[4-(2aminoethoxy)] or Phe(4-guanadino). In particular embodiments, X10 is not Tyr.

In certain embodiments, X11 is Trp or a Trp analog. In particular embodiments, X11 is 2-Nal or 1-Nal.

In particular embodiments, the peptide inhibitor of Formula III is cyclized. In certain embodiments, the peptide inhibitor is cyclized via an intramolecular bond between X4 and X9. In certain embodiments, the intramolecular bond is a thioether bond.

In certain embodiments, the peptide inhibitor of Formula III is linear or not cyclized. In particular embodiments of the linear peptide inhibitor of Formula III, X4 and/or X9 are any amino acid.

In particular embodiments of a peptide inhibitor of Formula III, one or more, two or more, or all three of X1, X2, and X3 are absent. In certain embodiments, X1 is absent. In certain embodiments, X1 and X2 are absent. In certain embodiments, X1, X2 and X3 are absent.

In particular embodiments of a peptide inhibitor of Formula III, one or more, two or more, three or more, four or more, or all of X16, X17, X18, X19 and X20 are absent. In particular embodiments of a peptide inhibitor of Formula III, one or more, two or more, three or more, or all of X17, X18, X19 and X20 are absent. In certain embodiments, one or more, two or more, or all three of X17, X19 and X20 are absent. In certain embodiments, one or more of X1, X2 and X3 are absent; and one or more, two or more, three or more, or four of X17, X18, X19 and X20 are absent.

In particular embodiments of a peptide inhibitor of Formula III, one of X4 or X9 is Abu, and the other of X4 or X9 is not Abu. In certain embodiments, X4 is Abu and X9 is Cys.

In particular embodiments, a peptide inhibitor of Formula III comprises one or more, two or more, three or more, or four of the following features: X5 is Arg or Gln; X6 is Thr; X7 is Trp; and X8 is Gln. In particular embodiments, X5 is Gln, X6 is Thr, X7 is Trp, and X8 is Gln. In certain embodiments, X5 is Gln. In certain embodiments, X1, X2 and X3 are absent. In certain embodiments, X4 is Abu and X9 is Cys.

In particular embodiments, a peptide inhibitor of Formula III comprises one or more, two or more, three or more, four or more, five or more, six or more, or seven of the following features: X10 is Tyr or a Phe analog; X11 is Trp, 2-Nal, 1-Nal, Phe(4-O-Allyl), Tyr(3-tBu), Phe(4-tBu), Phe(4-guanidino), Phe(4-OBzl) or Phe(4-Me); X12 is Arg, hLeu, (D)Asn, or any alpha methyl amino acids including, Aib, α-MeLys, α-MeLeu or α-MeOrn; X13 is Lys, Glu or Lys(Ac); X14 is Phe or Asn; X15 is β-Ala, Gln, Gly, Ser, Ala; and X16 is absent or AEA. In particular embodiments, a peptide inhibitor of Formula III comprises one or more, two or more, three or more, four or more, five or more, six or more, or seven of the following features: X10 is Tyr or a Phe analog; X11 is Trp, 2-Nal, 1-Nal, Phe(4-O-Allyl), Tyr(3-tBu), Phe(4-tBu), Phe(4-guanidino), Phe(4-OBzl) or Phe(4-Me); X12 is Arg, hLeu, (D)Asn, or any alpha methyl amino acids including, Aib, α-MeLys, α-MeLeu or α-MeOrn; X13 is Lys, Glu or Lys(Ac); X14 is Phe or Asn; X15 is Gly, Ser, Ala; and X16 is absent or AEA. In certain embodiments, the Phe analog is Phe(4-OBzl), Phe(4-OMe), Phe(4-CONH$_2$), Phe(3,4-Cl$_2$), Phe(4-tBu), Phe(4-NH2), Phe (4-Br), Phe(4-CN), Phe(4-carboxy), Phe[4-(2aminoethoxy)] or Phe(4-guanadino). In certain embodiments, X11 is 2-Nal or 1-Nal. In certain embodiments, X1, X2 and X3 are absent. In certain embodiments, X4 is Abu and X9 is Cys.

In particular embodiments, a peptide inhibitor of Formula III comprises one or more, two or more, three or more, four or more, five or more, six or more, or seven of the following features: X10 is Tyr or a Phe analog; X11 is Trp, 2-Nal, 1-Nal, Phe(4-O-Allyl), Tyr(3-tBu), Phe(4-tBu), Phe(4-guanidino), Phe(4-OBzl) or Phe(4-Me); X12 is Arg, hLeu, (D)Asn, 4-amino-4-carboxy-tetrahydropyran, Achc Acpc, Acbc, Acvc, Agp, Aib, α-DiethylGly, α-MeLys, α-MeLys (Ac), α-Me-Leu, α-MeOrn, α-MeSer, α-MeVal; X13 is Lys, Glu or Lys(Ac); X14 is Phe or Asn; X15 is Gly; and X16 is absent or AEA. In certain embodiments, the Phe analog is Phe(4-OBzl), Phe(4-OMe), Phe(4-CONH$_2$), Phe(3,4-C12), Phe(4-tBu), Phe(4-NH$_2$), Phe(4-Br), Phe(4-CN), Phe(4-carboxy), Phe(4-(2aminoethoxy)) or Phe(4-guanidino). In certain embodiments, X11 is 2-Nal or 1-Nal. In certain embodiments, X1, X2 and X3 are absent. In certain embodiments, X4 is Abu and X9 is Cys.

In particular embodiments, a peptide inhibitor of Formula III comprises one or more, two or more, three or more, four or more, five or more, six or more, seven or more, eight or more, nine or more, ten or more, or eleven of the following features: X5 is Arg or Gln; X6 is Thr; X7 is Trp; X8 is Gln; X10 is a Phe analog; X11 is Trp, 2-Nal, 1-Nal, Phe(4-O-Allyl), Tyr(3-tBu), Phe(4-tBu), Phe(4-guanidino), Phe(Bzl) or Phe(4-Me); X12 is Aib, α-MeLys, α-MeLeu, 4-amino-4-carboxy-tetrahydropyran, Achc Acpc, Acbc, Acvc, Agp, Aib, α-DiethylGly, α-MeLys, α-MeLys(Ac), α-Me-Leu, α-MeSer, α-MeVal, α-MeOrn; X13 is Lys, Glu or Lys(Ac); X14 is Phe or Asn; X15 is β-ala, Gly, Ser, Ala; and X16 is absent or AEA. In particular embodiments, a peptide inhibitor of Formula III comprises one or more, two or more, three or more, four or more, five or more, six or more, seven or more, eight or more, nine or more, ten or more, or eleven of the following features: X5 is Arg or Gln; X6 is Thr; X7 is Trp; X8 is Gln; X10 is a Phe analog; X11 is Trp, 2-Nal, 1-Nal, Phe(4-O-Allyl), Tyr(3-tBu), Phe(4-tBu), Phe(4-guanidino), Phe(Bzl) or Phe(4-Me); X12 is Aib, α-MeLys, α-MeLeu or α-MeOrn; X13 is Lys, Glu or Lys(Ac); X14 is Phe or Asn; X15 is Gly, Ser, Ala; and X16 is absent or AEA. In certain embodiments, the Phe analog is Phe(4-OBzl), Phe(4-OMe), Phe[4-(2aminoethoxy)], Phe(4-CONH$_2$), Phe (3,4-Cl$_2$), Phe(4-tBu), Phe(4-NH$_2$), Phe(4-Br), Phe(4-CN), Phe(4-CO$_2$H), or Phe(4-guanadino). In certain embodiments, X11 is 2-Nal or 1-Nal. In certain embodiments, X1, X2 and X3 are absent. In certain embodiments, X4 is Abu and X9 is Cys.

In particular embodiments, a peptide inhibitor of Formula III comprises one or more, two or more, three or more, four or more, five or more, six or more, seven or more, eight or more, nine or more, ten or more, or eleven of the following features: X5 is Arg or Gln; X6 is Thr; X7 is Trp; X8 is Gln;

X10 is Tyr or a Phe analog; X11 is Trp, 2-Nal, 1-Nal, Phe(4-O-Allyl), Tyr(3-tBu), Phe(4-tBu), Phe(4-guanidino), Phe(Bzl) or Phe(4-Me); X12 is Arg, hLeu, (D)Asn, 4-amino-4-carboxy-tetrahydropyran, Achc Acpc, Acbc, Acvc, Aib, α-DiethylGly, α-MeLys, α-MeLys(Ac), α-Me-Leu, α-MeSer, α-MeVal; X13 is Lys, Glu or Lys(Ac); X14 is Phe or Asn; X15 is β-Ala, Asn or Gly; and X16 is absent or AEA. In particular embodiments, a peptide inhibitor of Formula III comprises one or more, two or more, three or more, four or more, five or more, six or more, seven or more, eight or more, nine or more, ten or more, or eleven of the following features: X5 is Arg or Gln; X6 is Thr; X7 is Trp; X8 is Gln; X10 is Tyr or a Phe analog; X11 is Trp, 2-Nal, 1-Nal, Phe(4-O-Allyl), Tyr(3-tBu), Phe(4-tBu), Phe(4-guanidino), Phe(Bzl) or Phe(4-Me); X12 is Arg, hLeu, (D)Asn, α-MeLys, α-MeLeu or α-MeOrn, Aib; X13 is Lys, Glu or Lys(Ac); X14 is Phe or Asn; X15 is Gly; and X16 is absent or AEA. In certain embodiments, the Phe analog is Phe(4-OBzl), Phe(4OMe), Phe(4-CONH$_2$), Phe(3,4-Cl$_2$), Phe(4-tBu), Phe(4-NH$_2$), Phe(4-Br), Phe(4-CN), Phe(4-CO$_2$H), Phe(4-(2-aminoethoxy)) or Phe(4-guanidino). In certain embodiments, X11 is 2-Nal or 1-Nal. In certain embodiments, X1, X2 and X3 are absent. n certain embodiments, X4 is Abu and X9 is Cys.

In certain embodiments, the present invention includes a peptide of 8 to 20, 8 to 16 or 8 to 12 amino acids, optionally cyclized, comprising or consisting of a core sequence of Formula IIIb:

Xaa4-Xaa5-Xaa6-Trp-Xaa8-Xaa9-Xaa10-Xaa11　　(IIIb)

wherein Xaa4 and Xaa9 are each independently selected from Abu and Cys, wherein Xaa4 and Xaa9 are not both the same; Xaa5, Xaa6 and Xaa8 are any amino acid residue; Xaa10 is Tyr, a Phe analog or 2-Nal, and Xaa11 is 2-Nal or Trp, wherein the peptide inhibits binding of IL-23 to IL-23R. In particular embodiments, Xaa10 is Phe(4-OMe), 2-Nal, or Phe[4-(2-aminoethoxy)]. In one embodiment, Xaa10 is Phe(4-OMe). In one embodiment, Xaa7 is Phe[4-(2-aminoethoxy)]. In one embodiment, Xaa11 is 2-Nal. In certain embodiments, the peptide is cyclized via Xaa4 and Xaa9. In particular embodiments, the Phe analog is Phe[4-(2aminoethoxy)] or Phe(4-OMe). In certain embodiments, Xaa4 is Abu and Xaa9 is Cys, and the peptide is cyclized via Xaa4 and Xaa9. In particular embodiments, the peptide is a peptide inhibitor of Formula III, and wherein in certain embodiments, X1, X2 and X3 are absent. In particular embodiments, the peptide inhibits the binding of IL-23 to IL-23R. In certain embodiments, a peptide of Formula IIIb comprises a Glu, (D)Glu, Arg, (D)Arg, Phe, (D)Phe, 2-Nal, Thr, Leu, or (D)Gln bound to Xaa4. In certain embodiments, it is (D)Arg or (D)Phe.

In certain embodiments, the present invention includes a peptide of 8 to 20, 8 to 16 or 8 to 12 amino acids, optionally cyclized, comprising or consisting of a core sequence of Formula IIIc:

Abu-Xaa5-Xaa6-Trp-Xaa8-Cys-[Phe(4-OMe)]-(2-Nal)　　(IIIc)

wherein Xaa5, Xaa6 and Xaa8 are any amino acid residue; and wherein the peptide inhibits binding of IL-23 to IL-23R. In certain embodiments, the peptide is cyclized via Abu at Xaa4 and Cys at Xaa9. In certain embodiments, the peptide is a peptide inhibitor of Formula III, and wherein in certain embodiments, X1, X2 and X3 are absent. In particular embodiments, the peptide inhibits the binding of IL-23 to IL-23R. In certain embodiments, a peptide of Formula IIIc comprises a Glu, (D)Glu, Arg, (D)Arg, Phe, (D)Phe, 2-Nal, Thr, Leu, or (D)Gln bound to Abu. In certain embodiments, it is (D)Arg or (D)Phe.

In certain embodiments, the present invention includes a peptide of 8 to 20, 8 to 16 or 8 to 12 amino acids, optionally cyclized, comprising or consisting of a core sequence of Formula IIId:

Abu-Xaa5-Xaa6-Trp-Xaa8-Cys-Xaa10-Trp　　(IIId)

wherein Xaa5, Xaa6 and Xaa8 are any amino acid residue; Xaa10 is a modified Phe; and wherein the peptide inhibits binding of IL-23 to IL-23R. In particular embodiments, the modified Phe is Phe(4-tBu), Phe(4-guanidino), Phe[4-(2-aminoethoxy)], Phe(4-CO$_2$H), Phe(4-CN), Phe(4-Br), Phe(4-NH$_2$), PHe(CONH$_2$) or Phe(4-Me). In particular embodiments, the modified Phe is Phe(4-tBu), Phe(4-guanidino), Phe[4-(2-aminoethoxy)], Phe(4-CO$_2$H), Phe(4-CN), Phe(4-Br), Phe (4-NH$_2$), or Phe(4-Me). In one embodiment, Xaa10 is Phe[4-(2-aminoethoxy)] or Phe(4-OMe). In one embodiment, Xaa10 is Phe[4-(2-aminoethoxy)]. In certain embodiments, the peptide is cyclized via Abu at Xaa4 and Cys at Xaa9. In certain embodiments, the peptide is a peptide inhibitor of Formula III, and wherein in certain embodiments, X1, X2 and X3 are absent. In particular embodiments, the peptide inhibits the binding of IL-23 to IL-23R. In certain embodiments, a peptide of Formula IIId comprises a Glu, (D)Glu, Arg, (D)Arg, Phe, (D)Phe, 2-Nal, Thr, Leu, or (D)Gln bound to Abu. In certain embodiments, it is (D)Arg or (D)Phe.

In certain embodiments, the present invention includes a peptide, optionally 8 to 20, 8 to 16 or 8 to 12 amino acids, optionally cyclized, comprising or consisting of a core sequence of Formula IIIe:

Abu-Xaa5-Xaa6-Trp-Xaa8-Cys-Phe[4-(2-aminoethoxy)]-[2-Nal]　　(IIIe)

wherein Xaa5, Xaa6 and Xaa8 are any amino acid residue. In certain embodiments, the peptide is cyclized via Abu at Xaa4 and Cys at Xaa9. In certain embodiments, the peptide is a peptide inhibitor of Formula III, and wherein in certain embodiments, X1, X2 and X3 are absent. In particular embodiments, the peptide inhibits the binding of IL-23 to IL-23R. In certain embodiments, a peptide of Formula IIIb comprises a Glu, (D)Glu, Arg, (D)Arg, Phe, (D)Phe, 2-Nal, Thr, Leu, or (D)Gln bound to Abu. In certain embodiments, it is (D)Arg or (D)Phe.

In one embodiment, Xaa5 and Xaa8 is Gln. In one embodiment, Xaa6 is Thr. In certain embodiments, the peptide is cyclized via Abu at Xaa4 and Cys at Xaa9.

In particular embodiments of a peptide inhibitor of Formula III, the peptide inhibitor has a structure shown in any of Tables 5A-5C or comprises an amino acid sequence set forth in Tables 5A-5C.

Illustrative Peptide Inhibitors Containing Cyclic Amides

In certain embodiments, the present invention includes a peptide inhibitor of an interleukin-23 receptor, wherein the peptide inhibitor has the structure of Formula IV:

$$R^1-X-R^2 \quad\quad (IV)$$

or a pharmaceutically acceptable salt or solvate thereof, wherein $R^1$ is a bond, hydrogen, an C1-C6 alkyl, a C6-C12 aryl, a C6-C12 aryl C1-C6 alkyl, a C1-C20 alkanoyl, and including PEGylated versions alone or as spacers of any of the foregoing;

R² is a bond, OH or NH₂; and

X is an amino acid sequence of 8 to 20 amino acids, comprising or consisting of the sequence of Formula IVa:

X1-X2-X3-X4-X5-X6-W-X8-X9-X10-X11-X12-X13-X14-X15-X16-X17-X18-X19-X20        (IVa)

wherein

X1 is absent or any amino acid;
X2 is absent or any amino acid;
X3 is absent or any amino acid;
X4 is Dap, Dab, Glu, Asp, (D)-Asp or (D)-Dab;
X5 is Gln, Ala, Cys, Cit, Asp, Dab, Dap, Glu, Phe, Gly, His, hCys, Lys, Leu, Met, Asn, N-Me-Ala, N-M-Asn, N-Me-Lys, N-Me-Gln, N-Me-Arg, Orn, Pro, Pen, Gln, Arg, Ser, Thr, or Val;
X6 is Thr, Asp, Glu, Phe, Asn, Pro, Arg, Ser, or Thr;
X7 is Trp, Glu, Gly, Ile, Asn, Pro, Arg, Thr or OctGly;
X8 is Gln, Glu, Phe, Lys, Asn, Pro, Arg, Thr, or Trp;
X9 is Dap, Dab, Glu, Asp, (D)-Asp or (D)-Dab;
X10 is Tyr(OMe)Phe(4-OMe), 1-Nal, 2-Nal, Aic, α-MePhe, Bip, (D)Cys, Cha, DMT, (D)Tyr), Glu, Phe, His, hPhe(3,4-dimethoxy), hTyr, N-Me-Tyr, Trp, Phe(4-CONH₂), Phe(4-phenoxy), Thr, Tic, Tyr, Tyr(3-tBu), Phe(4-tBu), Phe(4-CN), Phe(4-NH₂), Phe(4-F), Phe(3,5-F₂), Phe(penta-F), Phe(3,4-Cl₂), Phe(4-CF₃), Bip, Cha, 4-pyridylalanine, βhTyr, OctGly, Phe(4-N₃), Phe(4-Br) or Phe[4-(2-aminoethoxy)];
X11 is 2-Nal, 1-Nal, 2,4-dimethylPhe, Bip, Phe(3,4-Cl₂), Phe(3,5-F₂), Phe(4-CONH₂), Phe(4-F), 4-phenylcyclohexylalanine, Phe(4-CF₃), α-MePhe, βhPhe, βhTyr, βhTrp, BIP, Nva(5-phenyl), Phe, His, hPhe, Tic, Tqa, Trp, Tyr, Phe(4-OMe), Phe(4-Me), Trp(2,5,7-tri-tertButyl), Phe(4-OAllyl), Tyr(3-tBu), Phe(4-tBu), Phe(4-guanidino), Tyr(Bzl), or OctGly;
X12 is α-MeLys, α-MeOrn, α-MeLeu, Aib, (D)Ala, (D)Asn, (D)Leu, (D)Asp, (D)Phe, (D)Thr, 3-Pal, Aib, β-Ala, β-Glu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr Tle, 4-amino-4-carboxy-tetrahydropyran, Achc Acpc, Acbc, Acvc, α-DiethylGly, α-MeLys, α-MeLys (Ac), α-Me-Leu, α-MeSer, α-MeVal;
X13 is Lys(Ac), (D)Asn, (D)Leu, (D)Thr, (D)Phe, Ala, Aib, α-MeLeu, Aib, β-Ala, β-Glu, βhAla, βhLeu, βhVal, β-spiro-pip, Cha, Chg, Asp, Dab, Dap, α-DiethylGly, Glu, Phe, hLeu, Lys, Lys(Ac), Leu, Asn, Ogl, Pro, Gln, Arg, Ser, β-spiro-pip, Thr, Tba, Tlc, Val or Tyr;
X14 is Asn, Glu, Phe, Gly, His, Lys, Leu, Met, Asn, Pro, Gln, Arg, Ser, Thr, Tic or Tyr;
X15 is β-ala, Asn, Gly, (D)Ala, (D)Asn, (D)Asp, (D)Leu, (D)Phe, (D)Thr, Ala, AEA, Asp, Glu, Phe, Gly, Lys, Leu, Pro, Gln, Arg or Ser;
X16 is absent, Gly, Ala, Asp, Ser, Pro, Asn or Thr;
X17 is absent, Glu, Ser, Gly or Gln;
X18 is absent or any amino acid;
X19 is absent or any amino acid; and
X20 is absent or any amino acid.

In certain embodiments of IVa: X12 is α-MeLys, α-MeOrn, α-MeLeu, Aib, (D)Ala, (D)Asn, (D)Leu, (D)Asp, (D)Phe, (D)Thr, 3-Pal, Aib, β-Ala, β-Glu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle; X13 is Lys(Ac), (D)Asn, (D)Leu, (D)Thr, (D)Phe, Ala, Aib, α-Me-Leu, Aib, β-Ala, β-Glu, βhAla, βhLeu, βhVal, β-spiro-pip, Cha, Chg, Asp, Dab, Dap, α-DiethylGly, Glu, Phe, hLeuLys, Leu, Asn, Ogl, Pro, Gln, Arg, Ser, β-spiro-pip, Thr, Tba, Tlc, Val or Tyr; X14 is Asn, Glu, Phe, Gly, His, Lys, Leu, Met, Asn, Pro, Gln, Arg, Ser, Thr, Tic or Tyr; and X15 is Gly, (D)Ala, (D)Asn, (D)Asp, (D)Leu, (D)Phe, (D)Thr, Ala, AEA, Asp, Glu, Phe, Gly, Lys, Leu, Pro, Gln, Arg or Ser.

In particular embodiments of a peptide inhibitor of Formula (IV): X5 is Cys, Cit, Asp, Dab, Dap, Gly, His, hCys, Lys, Met, Asn, N-Me-Ala, N-Me-Asn, N-Me-Lys, N-Me-Gln, N-Me-Arg, Orn, Pro, Pen, Gln, Val; X6 is Glu, Arg, Ser; X7 is Trp, Glu, Gly, Ile, Asn, Pro, Arg, Thr or OctGly; X8 is Phe, Asn, Pro, Arg, Thr, Trp; X10 is Phe(4-OMe), 1-Nal, 2-Nal, Aic, α-MePhe, Bip, (D)Cys, Cha, DMT, (D)Tyr, Glu, His, hPhe(3,4-dimethoxy), hTyr, N-Me-Tyr, Trp, Phe(4-CONH₂), Phe-(4-phenoxy), Thr, Tic, Tyr(3-tBu), Phe(4-tBu), Phe(4-CN), Phe(4-Br), Phe(4-NH₂), Phe(4-F), Phe(3,5-F₂), PheCH₂CO₂H, Phe(penta-F), Phe(3,4-Cl₂), Phe(4-CF₃), Bip, Cha, 4-PyridylAlanine, βhTyr, OctgGly, Tyr(4-N₃), Phe(4-Br), Phe[4-(2-aminoethoxy)]; X11 is 2-Nal, 1-Nal, 2,4-dimethylPhe, Bip, Phe(3,4-Cl₂), Phe(3,5-F₂), Phe (4-CONH₂), Phe(4-F), 4-phenylcyclohexyl, Phe(4-CF₃), α-MePhe, Nal, βhPhe, βhTyr, βhTrp, BIP, Nva(5-phenyl), Phe, His, hPhe, Tic, Tqa, Tyr, Phe(4-OMe), Phe(4-Me), Tyr(2,5,7-tri-tert-Butyl), Phe(4-OAllyl), Phe(3-tBu), Phe(4-tBu), Phe(4-guanidino), Tyr(Bzl), OctGly; X12 is α-Me-Lys, D-Ala, (D)Asn, (D)Asp, (D)Leu, (D)Phe, (D)Tyr, Aib, α-MeLeu, α-MeOrn, Aib, β-Ala, βhAla, βhArg, βhLeu, βhVal, β-spiro-pip, Glu, hArg, Ile, Lys, N-MeLeu, N-MeArg, Ogl, Orn, Pro, Gln, Ser, Thr, Tle, 4-amino-4-carboxy-tetrahydropyran, Achc Acpc, Acbc, Acvc, α-DiethylGly, α-MeLys(Ac), α-MeSer, α-MeVal; X13 is Lys, Lys (Ac), (D)Asn, (D)Leu, (D)Phe, (D)Thr, Ala, α-MeLeu, Aib, β-Ala, β-Glu, βhLeu, βhVal, β-spiro-pip, Cha, Chg, Asp, Dab, Dap, α-DiethylGly, hLeu, Asn, Ogl, Pro, Gln, Ser, Thr, Tba, Tle; X14 is Glu, Gly, His, Lys, Leu, Met, Asn, Pro, Gln, Arg, Ser, Thr, Tic; X15 is (D)Ala, (D)Asn, (D)Asp, (D)Leu, (D)Phe, (D)Thr, Aea, Asp, Glu, Phe, Gly, Lys, Leu, Pro, Asn, Arg or β-Ala; X16 is Gly, Ser, Pro, Asn, Thr; or X17 is Glu, Ser, Gly, Gln.

In particular embodiments of a peptide inhibitor of Formula (IV): X5 is Cys, Cit, Asp, Dab, Dap, Gly, His, hCys, Lys, Met, Asn, N-Me-Ala, N-Me-Asn, N-Me-Lys, N-Me-Gln, N-Me-Arg, Orn, Pro, Pen, Gln, Val; X6 is Glu, Arg, Ser; X7 is Trp, Glu, Gly, Ile, Asn, Pro, Arg, Thr or OctGly; X8 is Phe, Asn, Pro, Arg, Thr, Trp; X10 is Phe(4-OMe), 1-Nal, 2-Nal, Aic, α-MePhe, Bip, (D)Cys, Cha, DMT, (D)Tyr, Glu, His, hPhe(3,4-dimethoxy), hTyr, N-Me-Tyr, Trp, Phe(4-CONH₂), Phe-(4-phenoxy), Thr, Tic, Tyr(3-tBu), Phe(4-tBu), Phe(4-CN), Phe(4-Br), Phe(4-NH₂), Phe(4-F), Phe(3,5-F₂), PheCH₂CO₂H, Phe(penta-F), Phe(3,4-Cl₂), Phe(4-CF₃), Bip, Cha, 4-PyridylAlanine, βhTyr, OctgGly, Tyr(4-N₃), Phe(4-Br), Phe[4-(2-aminoethoxy)]; X11 is 2-Nal, 1-Nal, 2,4-dimethylPhe, Bip, Phe(3,4-Cl₂), Phe(3,5-F₂), Phe (4-CONH₂), Phe(4-F), 4-phenylcyclohexyl, Phe(4-CF₃), α-MePhe, Nal, βhPhe, βhTyr, βhTrp, BIP, Nva(5-phenyl), Phe, His, hPhe, Tic, Tqa, Tyr, Phe(4-OMe), Phe(4-Me), Tyr(2,5,7-tri-tert-Butyl), Phe(4-OAllyl), Phe(3-tBu), Phe(4-tBu), Phe(4-guanidino), Tyr(Bzl), OctGly; X12 is α-Me-Lys, D-Ala, (D)Asn, (D)Asp, (D)Leu, (D)Phe, (D)Tyr, Aib, α-MeLeu, α-MeOrn, Aib, β-Ala, βhAla, βhArg, βhLeu, βhVal, β-spiro-pip, Glu, hArg, Ile, Lys, N-MeLeu, N-MeArg, Ogl, Orn, Pro, Gln, Ser, Thr, Tle; X13 is Lys(Ac), (D)Asn, (D)Leu, (D)Phe, (D)Thr, Ala, α-MeLeu, Aib, β-Ala, β-Glu, βhLeu, βhVal, β-spiro-pip, Cha, Chg, Asp, Dab, Dap, α-DiethylGly, hLeu, Asn, Ogl, Pro, Gln, Ser, Thr, Tba, Tle; X14 is Glu, Gly, His, Lys, Leu, Met, Asn, Pro, Gln, Arg, Ser, Thr, Tic; X15 is (D)Ala, (D)Asn, (D)Asp, (D)Leu, (D)Phe, (D)Thr, Aea, Asp, Glu, Phe, Gly, Lys, Leu, Pro, Arg; X16 is Gly, Ser, Pro, Asn, Thr; or X17 is Glu, Ser, Gly, Gln.

In certain embodiments, the peptide inhibitor is cyclized. In particular embodiments, the peptide is cyclized through an intramolecular bond between X4 and X9. In particular embodiments, the intramolecular bond is an amide bond.

In certain embodiments, the peptide inhibitor is linear or not cyclized.

In particular embodiments of a peptide inhibitor of Formula IV, one or more, two or more, or all three of X1, X2, and X3 are absent.

In certain embodiments, X3 is Glu, (D)Glu, Arg, (D)Arg, Phe, (D)Phe, 2-Nal, Thr, Leu, or (D)Gln. In certain embodiments, X3 is (D)Arg or (D)Phe.

In particular embodiments of a peptide inhibitor of Formula IV, one or more, two or more, or all three of X17, X19 and X20 are absent.

In particular embodiments of a peptide inhibitor of Formula IV, X4 is Dap, Dab, or (D)Dab, and X9 is Glu, (D)Asp, or Asp. In particular embodiments of a peptide inhibitor of Formula I, X4 is Glu, (D)Asp or Asp, and X9 is Dab, Dap or (D)Dab.

In particular embodiments of a peptide inhibitor of Formula IV, X18 is (D)-Lys. In certain embodiments, X17 is absent and X18 is (D)-Lys.

In particular embodiments of a peptide inhibitor of Formula IV, the peptide inhibitor includes one or more, two or more, three or more, or all four of the following features: X5 is Gln; X6 is Thr; X7 is Trp; and X8 is Gln.

In particular embodiments of a peptide inhibitor of Formula IV, the peptide inhibitor includes one or more, two or more, three or more, four or more, five or more, six or more, or seven of the following features: X10 is Tyr, Phe[4-(2-aminoethoxy)], Phe(4-CONH$_2$) or Phe(4-OMe); X11 is 2-Nal or Trp; X12 is 4-amino-4-carboxy-tetrahydropyran, Achc Acpc, Acbc, Acvc, Aib, α-DiethylGly, α-MeLys, α-MeLys(Ac), α-Me-Leu, α-MeOrn, α-MeSer, α-MeVal, or Arg; X13 is Glu or Lys(Ac); X14 is Asn; X15 is Gly, Asn, or β-Ala; and X16 is AEA. In particular embodiments of a peptide inhibitor of Formula IV, the peptide inhibitor includes one or more, two or more, three or more, four or more, five or more, six or more, or seven of the following features: X10 is Tyr; X11 is Trp; X12 is Arg; X13 is Glu; X14 is Asn; X15 is Gly; and X16 is AEA.

In particular embodiments of a peptide inhibitor of Formula IV, the peptide inhibitor includes one or more, two or more, three or more, four or more, five or more, six or more, seven or more, eight or more, nine or more ten or more or all of the following features: X5 is Gln; X6 is Thr; X7 is Trp; X8 is Gln; X10 is Tyr; X11 is Trp; X12 is Arg; X13 is Glu or Lys(Ac); X14 is Asn; X15 is Gly; and X16 is AEA. In particular embodiments of a peptide inhibitor of Formula IV, the peptide inhibitor includes one or more, two or more, three or more, four or more, five or more, six or more, seven or more, eight or more, nine or more ten or more or all of the following features: X5 is Gln; X6 is Thr; X7 is Trp; X8 is Gln; X10 is Tyr; X11 is Trp; X12 is Arg; X13 is Glu; X14 is Asn; X15 is Gly; and X16 is AEA.

In certain embodiments of a peptide inhibitor of Formula IV, the peptide is cyclized via X4 and X9; X5, X6, X7 and X8 are Gln, Thr, Trp, and Gln, respectively; and X10, X11, X12, X13, X14, X15, and X16 are Tyr, Trp, Arg, Glu, Asn, Gly, and AEA, respectively.

In certain embodiments, the present invention includes a peptide of 8 to 20 amino acids, optionally cyclized, comprising or consisting of having a core sequence comprising:

Xaa4-Xaa5-Xaa6-Trp-Xaa8-Xaa9-[Phe(4-OMe)]-[2-Nal] (Formula IVb)

wherein Xaa4 and Xaa9 are each independently selected from Dap, Dab, Glu, Asp, (D)-Asp and (D)-Dab, wherein Xaa4 and Xaa9 are capable of forming an intramolecular bond, e.g., a cyclic amide; and Xaa5, Xaa6 and Xaa8 are any amino acid residue, wherein the peptide inhibits binding of IL-23 to IL-23R. In particular embodiments, the peptide inhibitor is a peptide inhibitor of Formula IV. In particular embodiments, the peptide inhibits the binding of IL-23 to IL-23R.

In certain embodiments, of a peptide inhibitor of Formula IV, the peptide inhibitor has a structure shown in Table 7 or comprises an amino acid sequence set forth in Table 7.

Optional Characteristics of Peptide Inhibitors

Any of the peptide inhibitors of the present invention (e.g., those of Formula I (Ia-It), II, III, IV or V) may be further defined, e.g., as described below. It is understood that each of the further defining features described herein may be applied to any peptide inhibitors where the amino acids designated at particular positions allow the presence of the further defining feature.

In certain embodiments of any of the peptide inhibitors described herein, the peptide inhibitor is cyclized.

In certain embodiments of any of the peptide inhibitors described herein, the peptide inhibitor or monomer subunit thereof is linear or not cyclized. In certain embodiments where the peptide is linear or not cyclized, X4 and X9 can be any amino acid.

In certain embodiments, the peptide inhibitor is cyclized, e.g., through X4 and X9.

In various embodiments, $R^1$ is a bond, hydrogen, a C1-C6 alkyl, a C6-C12 aryl, a C6-C12 aryl C1-C6 alkyl, or a C1-C20 alkanoyl, and including PEGylated versions alone or as spacers of any of the foregoing, e.g., acetyl. It is understood that the $R^1$ may replace or be present in addition to the typical amine group located at the amino terminus of a peptide. It is further understood that $R^1$ may be absent. In certain embodiments, the peptide inhibitor comprises an N-terminus selected from hydrogen, a C1-C6 alkyl, a C6-C12 aryl, a C6-C12 aryl C1-C6 alkyl, or a C1-C20 alkanoyl, and including PEGylated versions alone or as spacers of any of the foregoing, e.g., acetyl. In particular embodiments of any of the peptide inhibitors described herein, $R^1$ is hydrogen. In certain embodiments, $R^1$ is a bond, e.g., a covalent bond.

In certain embodiments of any of the peptide inhibitors having any of the various Formulas set forth herein, $R^1$ is selected from methyl, acetyl, formyl, benzoyl, trifluoroacetyl, isovaleryl, isobutyryl, octanyl, and the conjugated amides of lauric acid, hexadecanoic acid, and γ-Glu-hexadecanoic acid. In one embodiment, $R^1$ is pGlu. In certain embodiments, $R^1$ is hydrogen. In particular embodiments, $R^1$ is acetyl, whereby the peptide inhibitor is acylated at its N-terminus, e.g., to cap or protect an N-terminal amino acid residue, e.g., an N-terminal Pen or Abu residue.

In certain embodiments of any of the peptide inhibitors described herein, $R^1$ is an acid. In certain embodiments, $R^1$ is an acid selected from acetic acid, formic acid, benzoic acid, trifluoroacetic acid, isovaleric acid, isobutyric acid, octanoic acid, lauric acid, hexadecanoic acid, 4-Biphenylacetic acid, 4-fluorophenylacetic acid, gallic acid, pyroglutamic acid, cyclopentanepropionic acid, glycolic acid, oxalic acid, pyruvic acid, lactic acid, malonic acid, succinic acid, malic acid, maleic acid, fumaric acid, tartaric acid, citric acid, palmitic acid, benzoic acid, 3-(4-hydroxybenzoyl)benzoic acid, cinnamic acid, mandelic acid, 4-methylbicyclo (2.2.2)-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, muconic acid, an alkylsulfonic acid and an arylsulfonic acid.

In particular embodiments, $R^1$ is an alkylsulfonic acid selected from methanesulfonic acid, ethanesulfonic acid, 1,2-ethane-disulfonic acid, and 2-hydroxyethanesulfonic acid.

In particular embodiments, $R^1$ is an arylsulfonic acid selected from benzenesulfonic acid, 4-chlorobenzenesulfonic acid, 2-naphthalenesulfonic acid, 4-toluenesulfonic acid, and camphorsulfonic acid.

In some embodiments, wherein a peptide of the present invention comprises a conjugation to an acidic compound such as, e.g., isovaleric acid, isobutyric acid, valeric acid, and the like, the presence of such a conjugation is referenced in the acid form. So, for example, but not to be limited in any way, instead of indicating a conjugation of isovaleric acid to a peptide by referencing isovaleroyl (e.g., isovaleroyl-[Pen]-QTWQ[Pen]-[Phe(4-OMe)]-[2-Nal]-[α-MeLys]-[Lys(Ac)]-NG-NH$_2$ (SEQ ID NO: 262), in some embodiments, the present application references such a conjugation as isovaleric acid-[Pen]-QTWQ[Pen]-[Phe(4-OMe)]-[2-Nal]-[α-MeLys]-[Lys(Ac)]-NG-NH$_2$ (SEQ ID NO: 263). Reference to the conjugation in its acid form is intended to encompass the form present in the peptide inhibitor.

In certain embodiments, the peptide inhibitor comprises a C-terminus (e.g., $R^2$) selected from a bond, OH or NH$_2$. In certain embodiments, $R^2$ is a bond. In various embodiments of any of the peptide inhibitors having any of the various Formulas set forth herein, $R^2$ is OH or NH$_2$. It is understood that the $R^2$ may replace or be present in addition to the carboxyl group typically located at the carboxy terminus of a peptide. It is further understood that $R^2$ may be absent.

In particular embodiments of any of the peptide inhibitors having any of the various Formulae set forth herein, X comprises or consists of 7 to 35 amino acid residues, 8 to 35 amino acid residues, 9 to 35 amino acid residues, 10 to 35 amino acid residues, 7 to 25 amino acid residues, 8 to 25 amino acid residues, 9 to 25 amino acid residues, 10 to 25 amino acid residues, 7 to 20 amino acid residues, 8 to 20 amino acid residues, 9 to 20 amino acid residues, 7 to 18 amino acid residues, 8 to 18 amino acid residues, 9 to 18 amino acid residues, or 10 to 18 amino acid residues.

In certain embodiments of any of the Formulae set forth herein, X either or both does not comprise or does not consist of an amino acid sequence set forth in US Patent Application Publication No. US2013/0029907. In certain embodiments of any of the Formulae set forth herein, X either or both does not comprise or does not consist of an amino acid sequence set forth in US Patent Application Publication No. US2013/0172272.

In certain embodiments of any of the peptide inhibitors described herein, the peptide inhibitor, or each monomer subunit thereof, comprises or consists of at least 3, at least 4 at least 5, at least 6, or at least 7 amino acid residues carboxy terminal of the X9 amino acid residue. In particular embodiments of any of the peptide inhibitors described herein, the peptide inhibitor comprises 3 to 11, 3 to 10, 3 to 9, 3 to 8, 3 to 7, 3 to 6, 3 to 5, 3 to 4, 3, 4, 5, 6, 7, 8, 9, 10, or 11 amino acid residues carboxy terminal of the X9 amino acid residue.

In certain embodiments of any of the peptide inhibitors described herein, the peptide inhibitor, or each monomer subunit thereof, comprises or consists of 4 amino acid residues between X4 and X9. In one embodiment, both X4 and X9 are cysteines.

In certain embodiments of any of the peptide inhibitors described herein, the peptide inhibitor, or each monomer subunit thereof, comprises the amino acid sequence motif, W-X-X-Y-W, e.g., at positions X7-X11. In certain embodiments, the peptide inhibitor, or each monomer subunit thereof, comprises the amino acid sequence motif, C-X-X-W-X-C-Y-W (SEQ ID NO: 264), e.g., at positions X4-X11. In certain embodiments, the peptide inhibitor, or each monomer subunit thereof, comprises the amino acid sequence motif, Pen-X-X-W-X-Pen-Y-W, e.g., at positions X4-X11. In certain embodiments of any of the peptide inhibitors described herein, the peptide inhibitor, or both monomer subunit thereof, does not comprise the amino acid sequence motif, W-X-X-Y-W, e.g., at positions X7-X11, where X is any amino acid.

In certain embodiments of any of the Formula or peptide inhibitors described herein, the peptide inhibitor comprises one or more amino acid residues N-terminal to X4. In particular embodiments, X3 is present. In certain embodiments, X3 is Glu, (D)Glu, Arg, (D)Arg, Phe, (D)Phe, 2-Nal, Thr, Leu, or (D)Gln. In certain embodiments, X3 is (D)Arg or (D)Phe.

In particular embodiments of any of the Formula or peptide inhibitors described herein, the peptide inhibitor comprises an amino acid at X2. In particular embodiments, X2 is Glu, (D)Asp, Arg, (D)Arg, Phe, (D)Phe, 2-Nal, Thr, Leu, (D)Gln, or (D)Asn. In certain embodiments, X2 and X3 are present. In particular embodiments, X2 is Glu, (D)Asp, Arg, (D)Arg, Phe, (D)Phe, 2-Nal, Thr, Leu, (D)Gln, or (D)As, and X3 is (D)Arg.

In certain embodiments, a peptide inhibitor of the present invention, or one or both monomer subunits thereof, comprises, optionally at its C-terminus, one of the following amino acid sequences:

ENG;
ENN;
[4-amino-4-carboxy-tetrahydropyran]-ENN;
[Lys(Ac)]-NN;
[α-MeLys]-ENG (SEQ ID NO: 265);
[α-MeLys]-[Lys(Ac)]-NN (SEQ ID NO: 266);
[α-MeLeu]-[Lys(Ac)]-NN (SEQ ID NO: 267)
[α-MeLeu]-ENG (SEQ ID NO: 268);
[α-MeOrn]-[Lys(Ac)]-NG;
[α-MeLeu]-ENG (SEQ ID NO: 269);
Aib-[Lys(Ac)]-NG;
Aib-[Lys(Ac)]-NN;
NG-[AEA]-[(D)-Lys];
[Dapa]-NG-[AEA]-[(D)-Lys];
[Orn]-NG-[AEA]-[(D)-Lys];
[α-MeLys]-ENN (SEQ ID NO: 270);
[4-amino-4-carboxy-tetrahydropyran]-[Lys(Ac)]-NN;
[Achc]-[Lys(Ac)]-NN; or
[Acpc]-[Lys(Ac)]-NN.

In particular embodiments, one of these amino acid sequences constitutes the terminal C-terminal amino acids of the peptide. In particular embodiment, these amino acid sequences correspond to X13-X15 or X12-X15 or X14-X16 or X13-X17.

In certain embodiments, a peptide inhibitor of the present invention, or one or both monomer subunits thereof, comprises, optionally at its C-terminus, one of the following amino acid sequences:

WQCY-[2-Nal]-[α-MeLys] (SEQ ID NO: 271);
WQC-[Phe(4-OMe)]-[2-Nal]-[α-MeLys] (SEQ ID NO: 272);
WQC-[Phe(4-OMe)]-[2-Nal]-[Aib] (SEQ ID NO: 273);
WQ-[Pen]-[Phe(4-OMe)]-[2-Nal][α-MeLys] (SEQ ID NO: 274);
W-Xaa8-C-Phe[4-(2-aminoethoxy)]-[2-Nal];
W-Xaa8-C-Phe[4-(2-aminoethoxy)]-[1-Nal];
W-Xaa8-C-Phe[4-(2-aminoethoxy)]; or W-Xaa8-C-[Phe(4-OCH$_3$)]. In particular embodiments, one of these amino acid sequences constitutes the terminal C-terminal amino acids of the peptide. In particular embodiment, these amino acid sequences correspond to X7 to X12 or X7 to X11 or X7 to X10.

In certain embodiments of any of the peptide inhibitors described herein, including both peptide monomer inhibitors and monomer subunits of peptide dimer inhibitors, the peptide monomer inhibitor or monomer subunit is cyclized via a peptide bond between its N-terminal amino acid residue and its C-terminal amino acid residue. In particular embodiments, the peptide inhibitor (or monomer subunit thereof) comprises both an intramolecular bond between X4 and X9 and a peptide bond between its N-terminal amino acid residue and its C-terminal amino acid residue. In certain embodiments, the intramolecular bond is any of those described herein, e.g., a disulfide bond or a thioether bond.

In certain embodiments, the present invention includes a peptide inhibitor that comprises a core consensus sequence selected from one of the following (shown in N-terminal to C-terminal direction):

X1-X2-X3-Pen-X5-X6-W-X8-Pen-X10-X11-X12-X13-X14-X15;
Pen-X5-X6-W-Q-Pen;
Pen-X5-X6-W-X8-Pen;
Pen-X5-X6-W-X8-Pen-[Phe(4-CONH2)]; and
Pen-X5-X6-W-X8-Pen-[Phe[4-(2-aminoethoxy)]], wherein the Pen residues are joined by an intramolecular bond, e.g., disulphide bond. X1, X2, X3, X5, X6, X8, X10, X11, X12, X13, X14, and X15 may be any amino acid. In some embodiment X5 is Arg, Asn, Gln, Dap, Orn; X6 is Thr or Ser; and X8 is Gln, Val, Phe, Glu, Lys. In particular embodiments, X1, X2, X3, X5, X6, X8, X10, X11, X12, X13, X14, and X15 are defined as described in any of the various Formulas and peptide inhibitors described herein.

In certain embodiments, the present invention includes a peptide inhibitor that comprises a core consensus sequence selected from one of the following (shown in N-terminal to C-terminal direction):

X1-X2-X3-Abu-X5-X6-W-X8-C-X9-X10-X11-X12-X13-X14-X15;
Abu-X5-X6-W-Q-C;
Abu-X5-X6-W-X8-C;
Abu-X5-X6-W-X8-C-[Phe(4-CONH2)]; and
Abu-X5-X6-W-X8-C-[Phe[4-(2-aminoethoxy)]], where Abu and C are linked through a intra molecular thioether bond. X1, X2, X3, X5, X6, X8, X10, X11, X12, X13, X14, and X15 may be any amino acid. In some embodiment X5 is Arg, Asn, Gln, Dap, Orn; X6 is Thr or Ser; and X8 is Gln, Val, Phe, Glu, Lys. In particular embodiments, X1, X2, X3, X5, X6, X8, X10, X11, X12, X13, X14, and X15 are defined as described in any of the various Formulas and peptide inhibitors described herein.

In certain embodiments, any of the peptide inhibitors described herein may be further cyclized via a peptide bond between its N-terminal amino acid residue and its C-terminal amino acid residue. In particular embodiments, the peptide inhibitor comprises a peptide bond between X3 or X4 and any one of X9, X10, X11, X12, X13, X14, X15, X16, X17, X18, X19 or X20. In particular embodiments, peptide inhibitors of the present invention comprise a peptide bond between their N-terminal and C-terminal amino acid residues, and they also comprise an intramolecular bond between X4 and X9. In certain embodiments, the intramolecular bond is a disulfide bond, a thioether bond, a lactam bond or any of the other bonds described herein.

Peptide Dimers

In certain embodiments, the present invention includes dimers of the monomer peptide inhibitors described herein, including dimers of any of the monomer peptide inhibitors described herein, e.g., any of Formulas I, II, III, or IV, or shown in any of Tables 3A-3H, 4A, 4B, 5A-5C, 6, 7, 8, 9, 10, 11, 12, 13, 14 or 15. These dimers fall within the scope of the general term "peptide inhibitors" as used herein. Illustrative dimers of the present invention are also shown in Table 3F and 4A, which indicate the dimerized monomer subunits in brackets followed by the linker. Unless otherwise indicated, the subunits are linked via their C-termini. The term "dimer," as in a peptide dimer, refers to compounds in which two peptide monomer subunits are linked. A peptide dimer inhibitor of the present invention may comprise two identical monomer subunits, resulting in a homodimer, or two non-identical monomer subunits, resulting in a heterodimer. A cysteine dimer comprises two peptide monomer subunits linked through a disulfide bond between a cysteine residue in one monomer subunit and a cysteine residue in the other monomer subunit.

In some embodiments, the peptide inhibitors of the present invention may be active in a dimer conformation, in particular when free cysteine residues are present in the peptide. In certain embodiments, this occurs either as a synthesized dimer or, in particular, when a free cysteine monomer peptide is present and under oxidizing conditions, dimerizes. In some embodiments, the dimer is a homodimer. In other embodiments, the dimer is a heterodimer.

In certain embodiments, a peptide dimer inhibitor of the present invention is a peptide dimer comprising two peptide inhibitors of the invention, including but not limited to a homodimer or heterodimer comprising any of the peptide sequences shown herein, e.g., in Tables 3A-3H, 4A, 4B, 5A-5C, 6, 7, 8, 9, 10, 11, 12, 13, 14 or 15.

Certain amino acid sequences listed in Tables 3A-3H, 4A, 4B, 5A-5C, 6, 7, 8, 9, 10, 11, 12, 13, 14 or 15 are shown using one letter codes for amino acids. Where only the monomer peptide inhibitor sequences are shown; however it is understood that, in certain embodiments, these monomer peptide inhibitors, i.e., monomer subunits, are dimerized to form peptide dimer inhibitors, in accordance with the present teaching and as shown generally, e.g., in Tables 3A-3H, 4A, 4B, 5A-5C, 6, 7, 8, 9, 10, 11, 12, 13, 14 or 15.

In certain embodiments, monomer subunits of the present invention may be dimerized by a suitable linking moiety, e.g., a disulphide bridge between two cysteine residues, one in each peptide monomer subunit, or by another suitable linker moiety, including but not limited to those defined herein. Some of the monomer subunits are shown having C- and N-termini that both comprise free amine. Thus, to produce a peptide dimer inhibitor, the monomer subunit may be modified to eliminate either the C- or N-terminal free amine, thereby permitting dimerization at the remaining free amine. Further, in some instances, a terminal end of one or more monomer subunits is acylated with an acylating organic compound selected from the group consisting of: Trifluoropentyl, Acetyl, Octonyl, Butyl, Pentyl, Hexyl, Palmityl, Trifluoromethyl butyric, cyclopentane carboxylic, cyclopropylacetic, 4-fluorobenzoic, 4-fluorophenyl acetic, 3-Phenylpropionic, tetrahedro-2H-pyran-4carboxylic, succinic acid, and glutaric acid. In some instances, monomer subunits comprise both a free carboxy terminal and a free amino terminal, whereby a user may selectively modify the subunit to achieve dimerization at a desired terminus. One having skill in the art therefore, will appreciate that the monomer subunits of the instant invention may be selectively modified to achieve a single, specific amine for a desired dimerization.

It is further understood that the C-terminal residues of the monomer subunits disclosed herein are amides, unless otherwise indicated. Further, it is understood that, in certain embodiments, dimerization at the C-terminus is facilitated by using a suitable amino acid with a side chain having amine functionality, as is generally understood in the art. Regarding the N-terminal residues, it is generally understood that dimerization may be achieved through the free amine of the terminal residue, or may be achieved by using a suitable amino acid side chain having a free amine, as is generally understood in the art.

The linker moieties connecting monomer subunits may include any structure, length, and/or size that is compatible with the teachings herein. In at least one embodiment, a linker moiety is selected from the non-limiting group consisting of cysteine, lysine, DIG, PEG4, PEG4-biotin, PEG13, PEG25, PEG1K, PEG2K, PEG3.4K, PEG4K, PEG5K, IDA, ADA, Boc-IDA, Glutaric acid, Isophthalic acid, 1,3-phenylenediacetic acid, 1,4-phenylenediacetic acid, 1,2-phenylenediacetic acid, Triazine, Boc-Triazine, IDA-biotin, PEG4-Biotin, AADA, suitable aliphatics, aromatics, heteroaromatics, and polyethylene glycol based linkers having a molecular weight from approximately 400 Da to approximately 40,000 Da. Non-limiting examples of suitable linker moieties are provided in Table 2A.

TABLE 2A

Illustrative Linker Moieties

| Abbrivation | Discription | Structure |
|---|---|---|
| DIG | DIGlycolic acid, | |
| PEG4 | Bifunctional PEG linker with 4 PolyEthylene Glycol units | 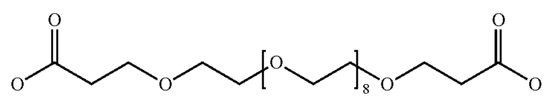 |
| PEG13 | Bifunctional PEG linker with 13 PolyEthylene Glycol units | 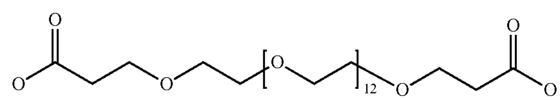 |
| PEG25 | Bifunctional PEG linker with 25 PolyEthylene Glycol units | 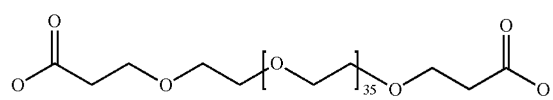 |
| PEG1K | Bifunctional PEG linker with PolyEthylene Glycol Mol wt of 1000Da | |
| PEG2K | Bifunctional PEG linker with PolyEthylene Glycol Mol wt of 2000Da | |
| PEG3.4K | Bifunctional PEG linker with PolyEthylene Glycol Mol wt of 3400Da | |
| PEG5K | Bifunctional PEG linker with PolyEthylene Glycol Mol wt of 5000Da | |
| DIG | DIGlycolic acid | |
| β-Ala-IDA | β-Ala-Iminodiacetic acid | 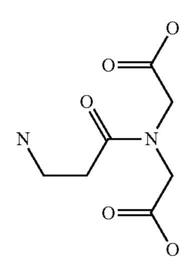 |

TABLE 2A-continued

| Abbrivation | Discription | Structure |
|---|---|---|
| Boc-β-Ala-IDA | Boc-β-Ala-Iminodiacetic acid | 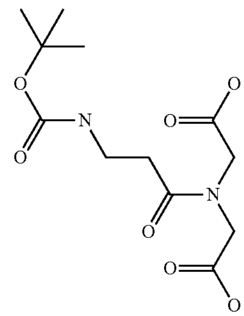 [SMILES: CC(C)(C)OC(=O)NCCC(=O)N(CC(=O)O)CC(=O)O] |
| Ac-β-Ala-IDA | Ac-β-Ala-Iminodiacetic acid | 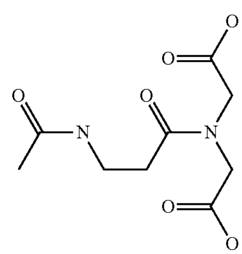 [SMILES: CC(=O)NCCC(=O)N(CC(=O)O)CC(=O)O] |
| IDA-β-Ala-Palm | Palmityl-β-Ala-Iminodiacetic acid | 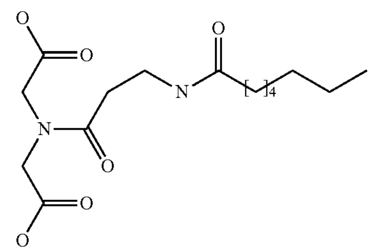 |
| GTA | Glutaric acid | 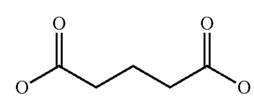 |
| PMA | Pemilic acid | 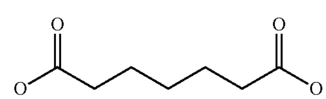 [SMILES: O=C(O)CCCCCC(=O)O] |
| AZA | Azelaic acid | 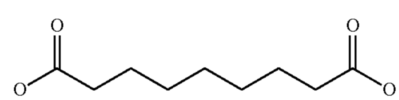 [SMILES: O=C(O)CCCCCCCC(=O)O] |
| DDA | Dodecanedioc acid | 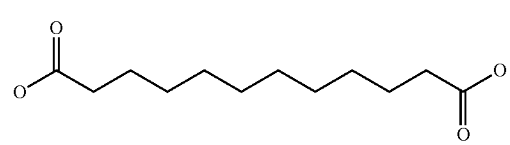 [SMILES: O=C(O)CCCCCCCCCCC(=O)O] |
| IPA | Isopthalic aicd | 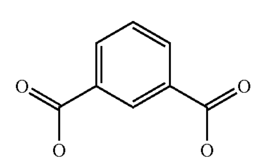 [SMILES: O=C(O)c1cccc(C(=O)O)c1] |

TABLE 2A-continued

Illustrative Linker Moieties

| Abbriviation | Discription | Structure |
| --- | --- | --- |
| 1,3-PDA | 1,3-Phenylene-diacetic acid | 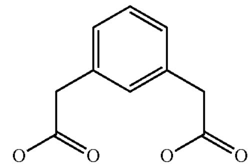 [SMILES: O=C(O)Cc1cccc(CC(=O)O)c1] |
| 1,4-PDA | 1,4-Phenylene-diacetic acid | 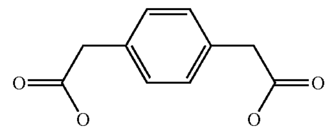 [SMILES: O=C(O)Cc1ccc(CC(=O)O)cc1] |
| 1,2-PDA | 1,2-Phenylene-diacetic acid | 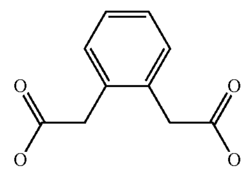 [SMILES: O=C(O)Cc1ccccc1CC(=O)O] |
| Triazine | Amino propyl Triazine di-acid | 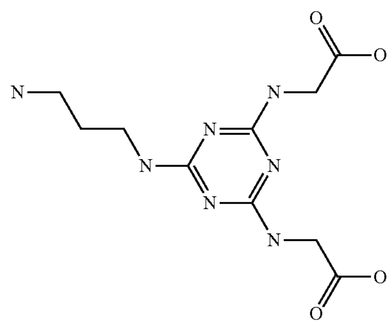 [SMILES: NCCCNc1nc(NCC(=O)O)nc(NCC(=O)O)n1] |
| Boc-Triazine | Boc-Triazine di-acid | 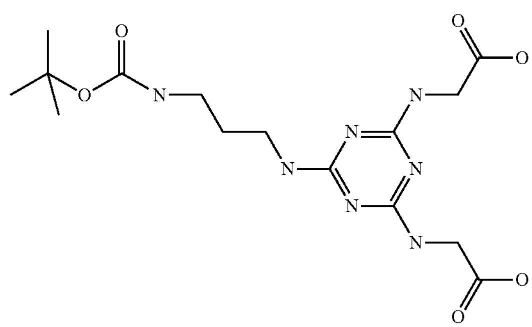 [SMILES: CC(C)(C)OC(=O)NCCCNc1nc(NCC(=O)O)nc(NCC(=O)O)n1] |
| ADA | Amino diacetic acid (which may also referred to as Iminodiacetic acid) | 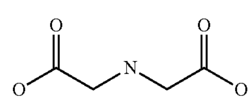 |
| AADA | n-Acetyl amino acetyl acid (which may also referred to as N-acetyl Iminodiacetic acid) | 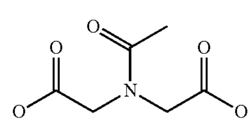 |
| PEG4-Biotin | PEG4-Biotin (Product number 10199, QuantaBioDesign) | 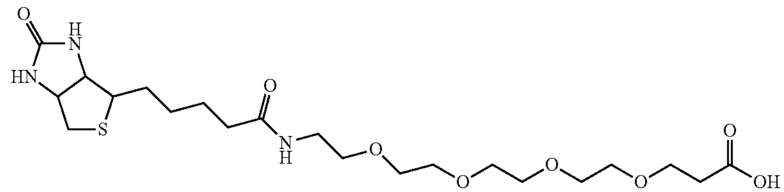 [SMILES: O=C(O)CCOCCOCCOCCOCCNC(=O)CCCCC1SCC2NC(=O)NC21] |

TABLE 2A-continued

Illustrative Linker Moieties

| Abbriviation | Discription | Structure |
|---|---|---|
| IDA-Biotin | N-Biotin-β-Ala-Iminodiacetic acid | 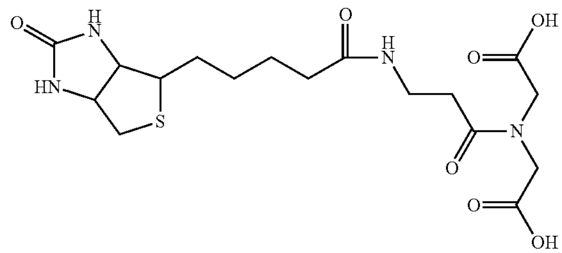 [SMILES: O=C(O)CN(CC(=O)O)C(=O)CCNC(=O)CCCCC1SCC2NC(=O)NC21] |
| Lys | Lysine | 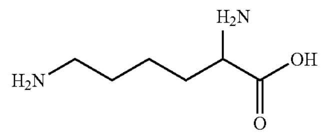 |

In some embodiments, a peptide dimer inhibitor is dimerized via a linker moiety. In some embodiments, a peptide dimer inhibitor is dimerized via an intermolecular disulfide bond formed between two cysteine residues, one in each monomer subunit. In some embodiments, a peptide dimer inhibitor is dimerized via both a linker moiety and an intermolecular disulfide bond formed between two cysteine residues. In some embodiments, the intramolecular bond is a thioether, lactam, triazole, selenoether, diselenide or olefin, instead of the disulfide bond.

An illustrative diagram of one embodiments of a dimer is shown below:

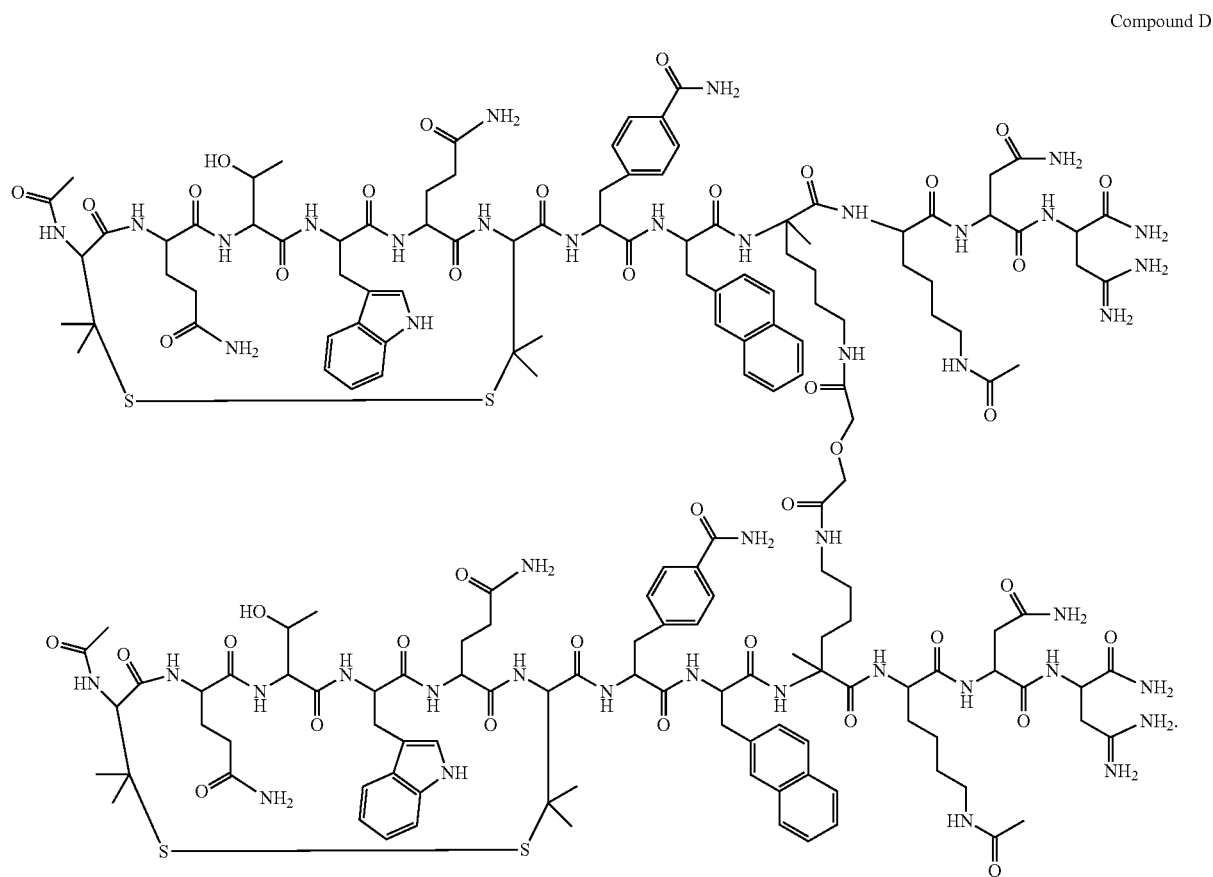 [SMILES: CC(=O)NCCCCC(NC(=O)C(C)(CCCCNC(=O)COCC(=O)NCCCCC(C)(NC(=O)C(Cc1ccc2ccccc2c1)NC(=O)C(Cc1ccc(C(N)=O)cc1)NC(=O)C1NC(=O)C(CCC(N)=O)NC(=O)C(Cc2c[nH]c3ccccc23)NC(=O)C(C(C)O)NC(=O)C(CCC(N)=O)NC(=O)C(NC(C)=O)C(C)(C)SSC1(C)C)C(=O)NC(CCCCNC(C)=O)C(=O)NC(CC(N)=O)C(=O)NC(CC(=N)N)C(N)=O)NC(=O)C(Cc1ccc2ccccc2c1)NC(=O)C(Cc1ccc(C(N)=O)cc1)NC(=O)C1NC(=O)C(CCC(N)=O)NC(=O)C(Cc2c[nH]c3ccccc23)NC(=O)C(C(C)O)NC(=O)C(CCC(N)=O)NC(=O)C(NC(C)=O)C(C)(C)SSC1(C)C)C(=O)NC(CC(N)=O)C(=O)NC(CC(=N)N)C(N)=O]

Compound D

One having skill in the art will appreciate that the linker (e.g., C- and N-terminal linker) moieties disclosed herein are non-limiting examples of suitable, and that the present invention may include any suitable linker moiety. Thus, some embodiments of the present invention comprises a homo- or heterodimer peptide inhibitor comprised of two monomer subunits selected from the peptides shown in any of Tables 3A-3H, 4A, 4B, 5A-5C, 6, 7, 8, 9, 10, 11, 12, 13, 14 or 15 or comprising or consisting of a sequence presented in any of Tables 3A-3H, 4A, 4B, 5A-5C, 6, 7, 8, 9, 10, 11, 12, 13, 14 or 15, wherein the C- or N-termini of the respective monomer subunits (or internal amino acid residues) are linked by any suitable linker moiety to provide a dimer peptide inhibitor having IL-23R inhibitory activity. In certain embodiments, a linker binds to the N- or C-terminus of one monomer subunit and an internal amino acid residue of the other monomer subunit making up the dimer. In certain embodiments, a linker binds to an internal amino acid residue of one monomer subunit and an internal amino acid residue of the other monomer subunit making up the dimer. In further embodiments, a linker binds to the N- or C-terminus of both subunits.

In particular embodiments, a peptide inhibitor of the present invention comprise two or more polypeptide sequences of monomer peptide inhibitors described herein.

In one embodiment, a peptide dimer inhibitor of the present invention comprises two peptide monomer subunits connected via one or more linker moieties, wherein each peptide monomer subunit comprises or consists of 7 to 35 amino acid residues, 8 to 35 amino acid residues, 9 to 35 amino acid residues, 10 to 35 amino acid residues, 7 to 25 amino acid residues, 8 to 25 amino acid residues, 9 to 25 amino acid residues, 10 to 25 amino acid residues, 7 to 20 amino acid residues, 8 to 20 amino acid residues, 9 to 20 amino acid residues, 7 to 18 amino acid residues, 8 to 18 amino acid residues, 9 to 18 amino acid residues, or 10 to 18 amino acid residues and comprises the sequence of Formula Ia, as described herein.

In particular embodiments, one or both of the monomer subunits comprise the sequence of any one of Formula Ix, Ia, Ib, Ic, Id, Ie, If, Ig, Ih, Ii, Ij, Ik, Il, Im, In, Io, Ip, Iq, Iq', Ir, Is or It, II, III, or IV as described herein.

In certain embodiments, a peptide dimer inhibitor comprises two peptide monomer subunits connected via one or more linker moieties, wherein each peptide monomer subunit is 8-20 amino acids in length and comprises a sequence of any one of Formula Ia, Formula Ib, Formula Ic, Formula Id, Formula Ie, Formula If, Formula Ig, Formula Ih, Formula Ii, Formula Ij, Formula Ik, Formula Il, Formula Im, Formula In, Formula Io, Formula Ip, Formula Iq, Formula Iq', Formula Ir, Formula Is, Formula It, any of the various Formula II, Formula III, or Formula IV. In certain embodiments, a peptide dimer inhibitor comprises two peptide monomer subunits connected via one or more linker moieties, wherein each peptide monomer subunit is 8-20 amino acids in length and comprises a sequence of any one of Formulas Ix, Ia-It, II, III, or IV.

In certain embodiments, a peptide dimer inhibitor has the structure of Formula V:

(R'—X—R²)₂-L        (V)

or a pharmaceutically acceptable salt or solvate thereof, wherein each R¹ is independently absent, a bond (e.g., a covalent bond), or selected from hydrogen, a C1-C6 alkyl, a C6-C12 aryl, a C6-C12 aryl C1-C6 alkyl, a C1-C20 alkanoyl, and including PEGylated versions alone or as spacers of any of the foregoing;

each R² is independently absent, a bond (e.g., a covalent bond), or selected from OH or NH₂, L is a linker moiety; and each X is an independently selected peptide monomer subunit comprising or consisting of 7 to 35 amino acid residues, 8 to 35 amino acid residues, 9 to 35 amino acid residues, 10 to 35 amino acid residues, 7 to 25 amino acid residues, 8 to 25 amino acid residues, 9 to 25 amino acid residues, 10 to 25 amino acid residues, 7 to 20 amino acid residues, 8 to 20 amino acid residues, 9 to 20 amino acid residues, 7 to 18 amino acid residues, 8 to 18 amino acid residues, 9 to 18 amino acid residues, or 10 to 18 amino acid residues amino acids in length, each comprising or consisting of the sequence of Formula Ia, as described herein. In particular embodiments, each peptide monomer subunit comprises or consists of a sequence of Formula Ix, Ia, Ib, Ic, Id, Ie, If, Ig, Ih, Ii, Ij, Ik, Il, Im, In, Io, Ip, Iq, Iq', Is, It, IIa, IIb, IIc, IId, IIIa, IIIb, IIIc, IIId, IIIe, IVa or IVb as described herein.

In certain embodiments, one or both peptide monomer subunit of a peptide dimer inhibitor is cyclized, e.g., via an intramolecular bond between X4 and X9. In certain embodiments wherein both peptide monomer subunits are cyclized, the intramolecular bond may be the same or different between the two peptide monomer subunits. In certain embodiments, one or both intramolecular bond is a disulfide bond, a thioether bond, a lactam bond, a selenoether, diselenide, or an olefin bond.

In one embodiment, X4 and X9 of the one or both cyclized peptide monomer subunit is independently selected from Cys, Pen, hCys, D-Pen, D-Cys and D-hCys, and the intramolecular bond is a disulfide bond.

In one embodiment, X4 and X9 of the one or both cyclized peptide monomer subunit is independently selected from Glu, Asp, Lys, Orn, Dap, Dab, D-Dap, D-Dab, D-Asp, D-Glu and D-Lys, and the intramolecular bond is a lactam bond.

In one embodiment, X4 and X9 of the one or both cyclized peptide monomer subunit are each independently selected from β-azido-Ala-OH, propargylglycine, and the peptide dimer inhibitor is cyclized through a triazole ring. In one embodiment, X4 and X9 of the one or both cyclized peptide monomer subunit are each independently selected from 2-allylglycine, 2-(3'-butenyl)glycine, 2-(4'-pentenyl) glycine, 2-(5'-hexenyl)glycine, and the peptide dimer inhibitor is cyclized vi a ring closing methasis to give the corresponding olefins/'stapled peptides'.

In one embodiment, X4 of one or both cyclized peptide monomer subunit is 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid, or hSer(Cl), X9 of one or both cyclized peptide monomer subunit is hSer(Cl), Cys, Pen, hCys, D-Pen, D-Cys or D-hCys, and the intramolecular bond is a thioether bond.

In one embodiment, X4 of one or both cyclized peptide monomer subunit is 2-chloromethylbenzoic acid, 2-chloro-acetic acid, 3-chloro-propanoic acid, 4-chloro-butyric acid, 3-chloro-isobutyric acid, hSer(Cl), or Sec, X9 of one or both cyclized peptide monomer subunit is hSer(Cl) or Sec, and the intramolecular bond is a selenoether bond.

In certain embodiments, one or both intramolecular bond is a diselenide bond.

In certain embodiments, one or both peptide monomer subunits is linear or not cyclized.

In particular embodiments, of the peptide dimer inhibitors, each X7 and each X11 are both W. In certain embodiments, each X7 and each X11 are both W, each X10 is Y, and each X4 and X9 are both C. In certain embodiments, each X7 and each X11 are both W, each X10 is Y, and each X4 and X9 are amino acids capable of forming an intramolecular bond that is a thioether bond, a lactam bond, a triazole, a selenoether, a diselenide bond, or an olefin bond.

In certain embodiments of the peptide dimer inhibitors, one or both peptide monomer subunit has a structure shown herein, e.g., in Tables 3A-3I, or comprises an amino acid sequence shown herein, e.g., as set forth in Tables 3A-3I, or wherein the peptide dimer inhibitor has a structure shown herein, e.g., in Table 3F, or comprises an amino acid sequence shown herein, e.g., as set forth in Table 3F.

In particular embodiments, each $R^1$ is independently a bond (e.g., a covalent bond), or selected from hydrogen, a C1-C6 alkyl, a C6-C12 aryl, a C6-C12 aryl C1-C6 alkyl, a C1-C20 alkanoyl, and including PEGylated versions alone or as spacers of any of the foregoing.

In certain embodiments of any of the peptide inhibitors having any of the various Formulae set forth herein, each $R^1$ is selected from methyl, acetyl, formyl, benzoyl, trifluoroacetyl, isovaleryl, isobutyryl, octanyl, and the conjugated amides of lauric acid, hexadecanoic acid, and γ-Glu-hexadecanoic acid.

In particular embodiments, each $R^2$ is independently a bond (e.g., a covalent bond), or selected from OH or $NH_2$.

In particular embodiments of any of the peptide inhibitors having any of the various Formulae set forth herein, each X comprises or consists of 7 to 35 amino acid residues, 8 to 35 amino acid residues, 9 to 35 amino acid residues, 10 to 35 amino acid residues, 7 to 25 amino acid residues, 8 to 25 amino acid residues, 9 to 25 amino acid residues, 10 to 25 amino acid residues, 7 to 18 amino acid residues, 8 to 18 amino acid residues, 9 to 18 amino acid residues, or 10 to 18 amino acid residues.

In particular embodiments, one or both X comprises or consists of the sequence of any one of Formula Ix, Ia, Ib, Ic, Id, Ie, If, Ig, Ih, Ii, Ij, Ik, Il, Im, In, Io, Ip, Iq, Iq', Ir, Is, It, IIa, IIb, IIc, IId, IIIa, IIIb, IIIc, IIId, IIIe, Iva or IVb as described herein. In certain embodiments of any of the peptide inhibitors, including dimers, or Formulae set forth herein, an X does not comprise or consist of an amino acid sequence set forth in US Patent Application Publication No. US2013/0029907. In certain embodiments of any of the peptide inhibitors, including dimers, or Formulae set forth herein, an X does not comprise or consist of an amino acid sequence set forth in US Patent Application Publication No. US2013/0172272.

In particular embodiments of peptide inhibitors of the present invention (both monomers and dimers) comprising Cys at position X4 and Cys at position X9, the Cys at position X4 and and the Cys at position X9 are linked by a disulphide bridge.

In particular embodiments of peptide inhibitors of the present invention, each X7 and each X11 are not both W.

In particular embodiments of peptide inhibitors of the present invention, each X7 and each X11 are both W.

In particular embodiments of peptide inhibitors of the present invention, each X7 and each X11 are both W, X10 is Y, and X4 and X9 are both C.

In certain embodiments, at least two cysteine residues of the peptide dimer inhibitor are linked by a disulphide bridge, either intramolecular or intermolecular.

In particular embodiments of either or both monomer subunit (e.g., Ix, Ia-It where permissible) present in a peptide dimer inhibitor, X4 and X9 are both Cys.

In particular embodiments of either or both monomer subunit (e.g., Ix, Ia-It where permissible) present in a peptide dimer inhibitor, X7 and X11 are both W.

In particular embodiments of either or both monomer subunit (e.g., Ia-It where permissible) present in a peptide dimer inhibitor, X7 and X11 are both W, X10 is Y, and X4 and X9 are both Cys.

In particular embodiments of either or both monomer subunit (e.g., Ia-It where permissible) present in a peptide dimer inhibitor, X15 is Gly or Ser.

In particular embodiments of either or both monomer subunit (e.g., Ia-It where permissible) present in a peptide dimer inhibitor, X16 is AEA or AEP.

In particular embodiments of either or both monomer subunit (e.g., Ia-It where permissible) present in a peptide dimer inhibitor, X10 is Tyr or Phe, or an analog of Tyr or Phe.

In particular embodiments of either or both monomer subunit (e.g., Ia-It where permissible) present in a peptide dimer inhibitor, X11 is Trp.

In particular embodiments of any of the peptide dimer inhibitors described herein, either or both $R^1$ is hydrogen.

In particular embodiments of peptide dimer inhibitors of the present invention, the linker moiety (L) is any of the linkers described herein or shown in Table 2A or 2B. In certain embodiments, L is a lysine linker, a diethylene glycol linker, an iminodiacetic acid (IDA) linker, a β-Ala-iminodiaceticacid (β-Ala-IDA) linker, or a PEG linker.

In various embodiments of any of the peptide dimer inhibitors, each of the peptide monomer subunits is attached to a linker moiety via its N-terminus, C-terminus, or an internal amino acid residue.

In certain embodiments of any of the peptide dimer inhibitors, the N-terminus of each peptide monomer subunit is connected by a linker moiety.

In certain embodiments of any of the peptide dimer inhibitors, the C-terminus of each peptide monomer subunit is connected by a linker moiety.

In certain embodiments of any of the peptide dimer inhibitors, each peptide monomer subunit is connected by a linker moiety attached to an internal amino acid.

In certain embodiments of peptide dimer inhibitors, the linker moiety is a diethylene glycol linker, an iminodiacetic acid (IDA) linker, a β-Ala-iminodiaceticacid (β-Ala-IDA) linker, or a PEG linker.

In certain embodiments of the peptide dimer inhibitors, one or both peptide monomer subunit has a structure shown in Tables 3A-3H, 4A, 4B, 5A-5C, 6, 7, 8, 9, 10, 11, 12, 13, 14 or 15 or comprises an amino acid sequence set forth in Tables 3A-3H, 4A, 4B, 5A-5C, 6, 7, 8, 9, 10, 11, 12, 13, 14 or 15.

In certain embodiments of any of the peptide inhibitors, including dimers, or Formulae set forth herein, an X does not comprise or consist of an amino acid sequence set forth in US Patent Application Publication No. US2013/0029907. In certain embodiments of any of the peptide inhibitors, including dimers, or Formulas set forth herein, an X does not comprise or consist of an amino acid sequence set forth in US Patent Application Publication No. US2013/0172272.

In particular embodiments of peptide inhibitors of the present invention, each X7 and each X11 are both W, X10 is Y, and X4 and X9 are both Pen.

In certain embodiments, at least two cysteine residues of the peptide dimer inhibitor are linked by a disulphide bridge, either intramolecular or intermolecular. Peptide Inhibitor Conjugates and Biopolymers In certain embodiments, peptide inhibitors of the present invention, including both monomers and dimers, comprise one or more conjugated chemical substituents, such as lipophilic substituents and polymeric moieties. Without wishing to be bound by any particular theory, it is believed that the lipophilic substituent binds to albumin in the bloodstream, thereby shielding the peptide inhibitor from enzymatic degradation, and thus enhancing its half-life. In addition, it is believed that polymeric moieties enhance half-life and reduce clearance in the bloodstream. In certain embodiments, the half-life of a peptide inhibitor of the invention that includes a conjugated chemical substituent is at least 100%, at least 120%, at least 150%, at least 200%, at least 250%, at least 300%, at least 400%, or at least 500% of the half-life of the same peptide inhibitor but without the conjugated chemical substituent. In certain embodiments, the lipophilic substituents and/or polypermic moieties enhance the permeability of the peptide inhibitor through the epithelium and/or its retention in the lamina propria. In certain embodiments, the permeability through the epithelium and/or the retention in the lamina propria of a peptide inhibitor of the invention that includes a conjugated chemical substituent is at 100%, at least 120%, at least 150%, at least 200%, at least 250%, at least 300%, at least 400%, or at least 500% of the half-life of the same peptide inhibitor but without the conjugated chemical substituent.

In one embodiment, a side chain of one or more amino acid residues (e.g., Lys residues) in a peptide inhibitor of the invention is conjugated (e.g., covalently attached) to a lipophilic substituent. The lipophilic substituent may be covalently bonded to an atom in the amino acid side chain, or alternatively may be conjugated to the amino acid side chain via one or more spacers. The spacer, when present, may provide spacing between the peptide analogue and the lipophilic substituent.

In certain embodiments, the lipophilic substituent may comprise a hydrocarbon chain having from 4 to 30 C atoms, for example at least 8 or 12 C atoms, and preferably 24 C atoms or fewer, or 20 C atoms or fewer. The hydrocarbon chain may be linear or branched and may be saturated or unsaturated. In certain embodiments, the hydrocarbon chain is substituted with a moiety which forms part of the attachment to the amino acid side chain or the spacer, for example an acyl group, a sulfonyl group, an N atom, an O atom or an S atom. In some embodiments, the hydrocarbon chain is substituted with an acyl group, and accordingly the hydrocarbon chain may form part of an alkanoyl group, for example palmitoyl, caproyl, lauroyl, myristoyl or stearoyl.

A lipophilic substituent may be conjugated to any amino acid side chain in a peptide inhibitor of the invention. In certain embodiment, the amino acid side chain includes a carboxy, hydroxyl, thiol, amide or amine group, for forming an ester, a sulphonyl ester, a thioester, an amide or a sulphonamide with the spacer or lipophilic substituent. For example, the lipophilic substituent may be conjugated to Asn, Asp, Glu, Gln, His, Lys, Arg, Ser, Thr, Tyr, Trp, Cys or Dbu, Dpr or Orn. In certain embodiments, the lipophilic substituent is conjugated to Lys. An amino acid shown as Lys in any of the formula provided herein may be replaced by, e.g., Dbu, Dpr or Orn where a lipophilic substituent is added.

In certain embodiments, the peptide inhibitors of the present invention may be modified, e.g., to enhance stability, increase permeability, or enhance drug like characteristics, through conjugation of a chemical moiety to one or more amino acid side chain within the peptide. For example, the N(epsilon) of lysine N(epsilon), the β-carboxyl of aspartic, or the γ-carboxyl of glutamic acid may be appropriately functionalized. Thus, to produce the modified peptide, an amino acid within the peptide may be appropriately modified. Further, in some instances, the side chain is acylated with an acylating organic compound selected from the group consisting of: Trifluoropentyl, Acetyl, Octonyl, Butyl, Pentyl, Hexyl, Palmityl, Trifluoromethyl butyric, cyclopentane carboxylic, cyclopropylacetic, 4-fluorobenzoic, 4-fluorophenyl acetic, 3-Phenylpropionic, tetrahedro-2H-pyran-4carboxylic, succinic acid glutaric acid or bile acids. One having skill is the art will appreciate that a series of conjugates can be linked, e.g., for example PEG4, isoglu and combinations thereof. One having skill is the art will appreciate that an amino acid with the peptide can be isosterically replaced, for example, Lys may be replaced for Dap, Dab, α-MeLys or Orn. Examples of modified residues within a peptide are shown in Table 1B.

TABLE 1B

Examples of modified Lysine, Asp and Asn within peptide

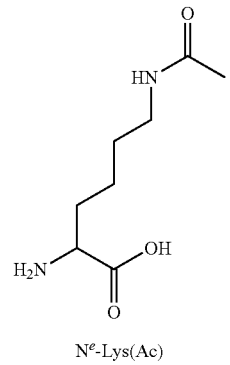

$N^e$-Lys(Ac)

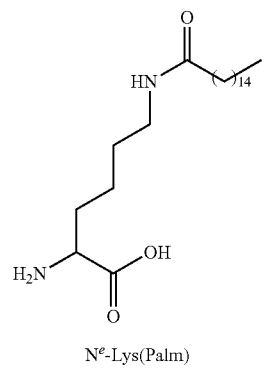

$N^e$-Lys(Palm)

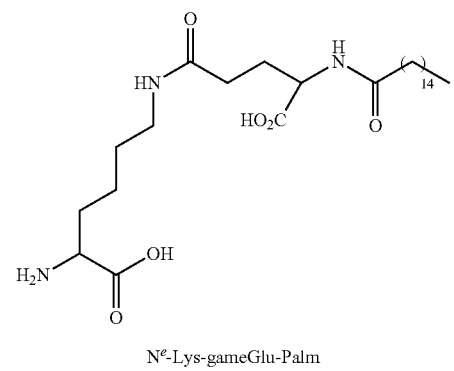

$N^e$-Lys-gameGlu-Palm

TABLE 1B-continued
Examples of modified Lysine, Asp and Asn within peptide
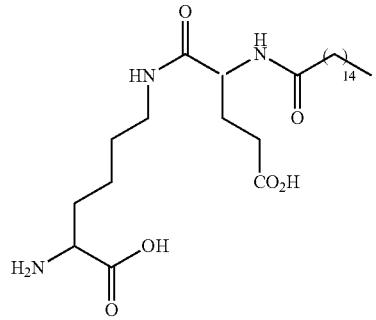
N$^e$-Lys-isoGlu-Palm
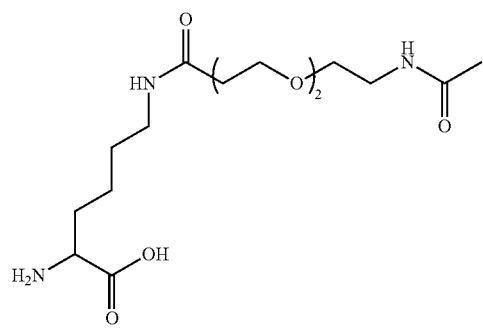
N$^e$-Lys(PEG2-Ac)
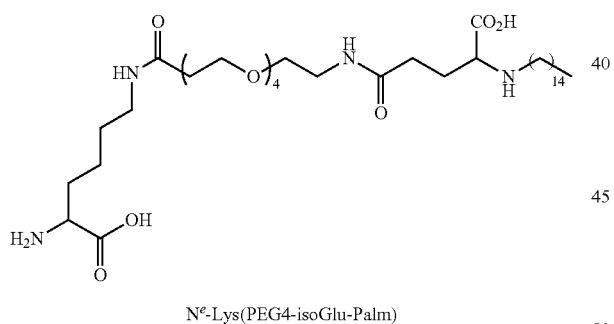
N$^e$-Lys(PEG4-isoGlu-Palm)
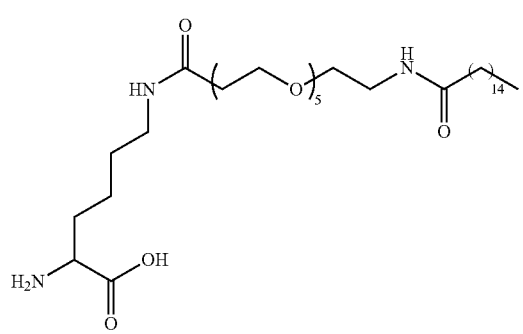
N$^e$-Lys(PEG)$_5$-Palm
TABLE 1B-continued
Examples of modified Lysine, Asp and Asn within peptide
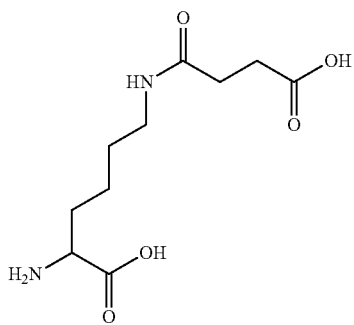
N$^e$-Lys(succinic acid)
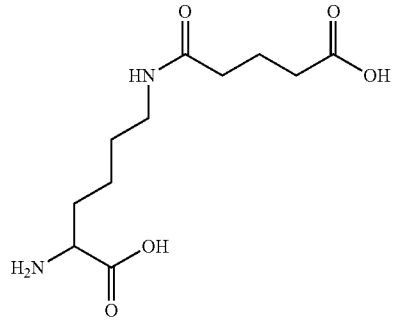
N$^e$-Lys(glutaric acid)
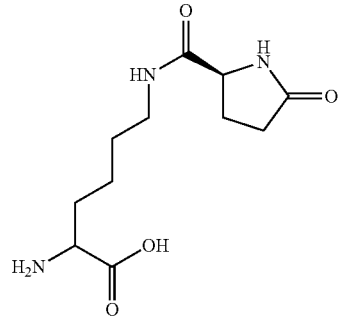
N$^e$-Lys(Pyroglutaric acid)
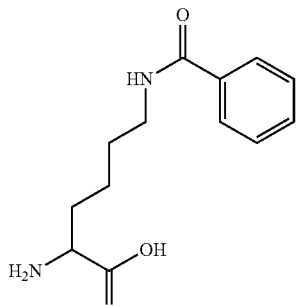
N$^e$-Lys(Benzoic acid)

TABLE 1B-continued

Examples of modified Lysine, Asp and Asn within peptide

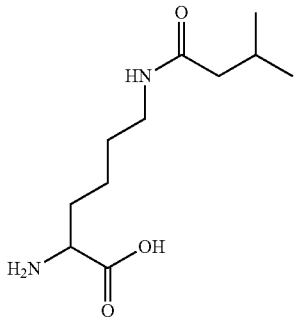

N$^e$-Lys(IVA)

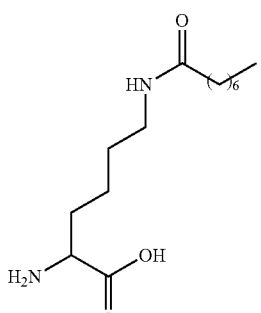

N$^e$-Lys(octanoic acid)

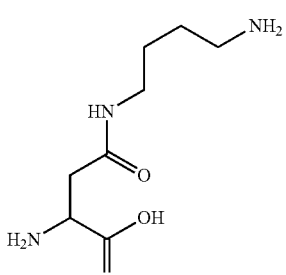

Asp(1,4 diaminobutane)

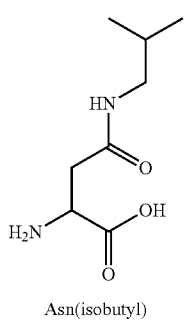

Asn(isobutyl)

TABLE 1B-continued

Examples of modified Lysine, Asp and Asn within peptide

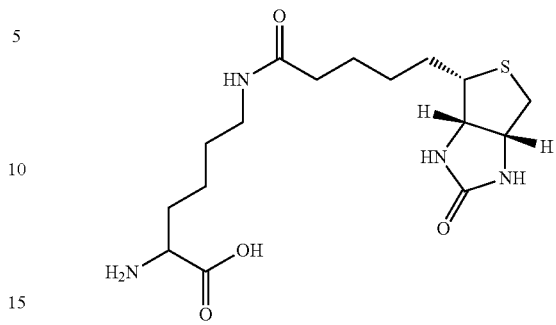

N$^e$-Lys(Biotin)

In further embodiments of the present invention, alternatively or additionally, a side-chain of one or more amino acid residues in a peptide inhibitor of the invention is conjugated to a polymeric moiety, for example, in order to increase solubility and/or half-life in vivo (e.g. in plasma) and/or bioavailability. Such modifications are also known to reduce clearance (e.g. renal clearance) of therapeutic proteins and peptides.

As used herein, "Polyethylene glycol" or "PEG" is a polyether compound of general formula H—(O—CH2-CH2)n-OH. PEGs are also known as polyethylene oxides (PEOs) or polyoxyethylenes (POEs), depending on their molecular weight PEO, PEE, or POG, as used herein, refers to an oligomer or polymer of ethylene oxide. The three names are chemically synonymous, but PEG has tended to refer to oligomers and polymers with a molecular mass below 20,000 Da, PEO to polymers with a molecular mass above 20,000 Da, and POE to a polymer of any molecular mass. PEG and PEO are liquids or low-melting solids, depending on their molecular weights. Throughout this disclosure, the 3 names are used indistinguishably. PEGs are prepared by polymerization of ethylene oxide and are commercially available over a wide range of molecular weights from 300 Da to 10,000,000 Da. While PEG and PEO with different molecular weights find use in different applications, and have different physical properties (e.g. viscosity) due to chain length effects, their chemical properties are nearly identical. The polymeric moiety is preferably water-soluble (amphiphilic or hydrophilic), non-toxic, and pharmaceutically inert. Suitable polymeric moieties include polyethylene glycols (PEG), homo- or co-polymers of PEG, a monomethyl-substituted polymer of PEG (mPEG), or polyoxyethylene glycerol (POG). See, for example, Int. J. Hematology 68:1 (1998); Bioconjugate Chem. 6:150 (1995); and Crit. Rev. Therap. Drug Carrier Sys. 9:249 (1992). Also encompassed are PEGs that are prepared for purpose of half life extension, for example, mono-activated, alkoxy-terminated polyalkylene oxides (POA's) such as mono-methoxy-terminated polyethylene glycols (mPEG's); bis activated polyethylene oxides (glycols) or other PEG derivatives are also contemplated. Suitable polymers will vary substantially by weights ranging from about 200 Da to about 40,000 Da or from about 200 Da to about 60,000 Da are usually selected for the purposes of the present invention. In certain embodiments, PEGs having molecular weights from 200 to 2,000 or from 200 to 500 are used. Different forms of PEG may also be used, depending on the initiator used for the polymerization process—a common common initiator is a monofunctional methyl ether PEG, or methoxypoly(ethylene glycol), abbreviated mPEG.

Lower-molecular-weight PEGs are also available as pure oligomers, referred to as monodisperse, uniform, or discrete. These are used in certain embodiments of the present invention.

PEGs are also available with different geometries: branched PEGs have three to ten PEG chains emanating from a central core group; star PEGs have 10 to 100 PEG chains emanating from a central core group; and comb PEGs have multiple PEG chains normally grafted onto a polymer backbone. PEGs can also be linear. The numbers that are often included in the names of PEGs indicate their average molecular weights (e.g. a PEG with n=9 would have an average molecular weight of approximately 400 daltons, and would be labeled PEG 400.

As used herein, "PEGylation" is the act of covalently coupling a PEG structure to the peptide inhibitor of the invention, which is then referred to as a "PEGylated peptide inhibitor". In certain embodiments, the PEG of the PEGylated side chain is a PEG with a molecular weight from about 200 to about 40,000. In some embodiments, a spacer of a peptide of formula I, formula I', or formula I" is PEGylated. In certain embodiments, the PEG of a PEGylated spacer is PEG3, PEG4, PEGS, PEG6, PEG7, PEG8, PEGS, PEG10, or PEG11. In certain embodiments, the PEG of a PEGylated spacer is PEG3 or PEG8.

Other suitable polymeric moieties include poly-amino acids such as poly-lysine, poly-aspartic acid and poly-glutamic acid (see for example Gombotz, et al. (1995), Bioconjugate Chem., vol. 6: 332-351; Hudecz, et al. (1992), Bioconjugate Chem., vol. 3, 49-57 and Tsukada, et al. (1984), J. Natl. Cancer Inst., vol. 73, 721-729. The polymeric moiety may be straight-chain or branched. In some embodiments, it has a molecular weight of 500-40,000 Da, for example 500-10,000 Da, 1000-5000 Da, 10,000-20,000 Da, or 20,000-40,000 Da.

In some embodiments, a peptide inhibitor of the invention may comprise two or more such polymeric moieties, in which case the total molecular weight of all such moieties will generally fall within the ranges provided above.

In some embodiments, the polymeric moiety is coupled (by covalent linkage) to an amino, carboxyl or thiol group of an amino acid side chain. Certain examples are the thiol group of Cys residues and the epsilon amino group of Lys residues, and the carboxyl groups of Asp and Glu residues may also be involved.

The skilled worker will be well aware of suitable techniques which can be used to perform the coupling reaction. For example, a PEG moiety bearing a methoxy group can be coupled to a Cys thiol group by a maleimido linkage using reagents commercially available from Nektar Therapeutics AL. See also WO 2008/101017, and the references cited above, for details of suitable chemistry. A maleimide-functionalised PEG may also be conjugated to the side-chain sulfhydryl group of a Cys residue.

As used herein, disulfide bond oxidation can occur within a single step or is a two step process. As used herein, for a single oxidation step, the trityl protecting group is often employed during assembly, allowing deprotection during cleavage, followed by solution oxidation. When a second disulfide bond is required, one has the option of native or selective oxidation. For selective oxidation requiring orthogonal protecting groups, Acm and Trityl is used as the protecting groups for cysteine. Cleavage results in the removal of one protecting pair of cysteine allowing oxidation of this pair. The second oxidative deprotection step of the cysteine protected Acm group is then performed. For native oxidation, the trityl protecting group is used for all cysteines, allowing for natural folding of the peptide. A skilled worker will be well aware of suitable techniques which can be used to perform the oxidation step.

Several chemical moieties, including poly(ethylene)glycol, react with functional groups present in the twenty naturally occurring amino acids, such as, for example, the epsilon amino group in lysine amino acid residues, the thiol present in cysteine amino acid residues, or other nucleophilic amino acid side chains. When multiple naturally occurring amino acids react in a peptide inhibitor, these non-specific chemical reactions result in a final peptide inhibitor that contains many isomers of peptides conjugated to one or more poly(ethylene)glycol strands at different locations within the peptide inhibitor.

One advantage of certain embodiments of the present invention includes the ability to add one or more chemical moiety (such as PEG) by incorporating one or more non-natural amino acid(s) that possess unique functional groups that react with an activated PEG by way of chemistry that is unreactive with the naturally occurring amino acids present in the peptide inhibitor. For example, azide and alkyne groups are unreactive with all naturally occurring functional groups in a protein. Thus, a non-natural amino acid may be incorporated in one or more specific sites in a peptide inhibitor where PEG or another modification is desired without the undesirable non-specific reactions. In certain embodiments, the particular chemistry involved in the reaction results in a stable, covalent link between the PEG strand the peptide inhibitor. In addition, such reactions may be performed in mild aqueous conditions that are not damaging to most peptides. In certain embodiments, the non-natural amino acid residue is AHA.

Chemical moieties attached to natural amino acids are limited in number and scope. By contrast, chemical moieties attached to non-natural amino acids can utilize a significantly greater spectrum of useful chemistries by which to attach the chemical moiety to the target molecule. Essentially any target molecule, including any protein (or portion thereof) that includes a non-natural amino acid, e.g., a non-natural amino acid containing a reactive site or side chain where a chemical moiety may attach, such as an aldehyde- or keto-derivatized amino acid, can serve as a substrate for attaching a chemical moiety.

Numerous chemical moieties may be joined or linked to a particular molecule through various known methods in the art. A variety of such methods are described in U.S. Pat. No. 8,568,706. As an illustrative example, azide moieties may be useful in conjugating chemical moieties such as PEG or others described herein. The azide moiety serves as a reactive functional group, and is absent in most naturally occurring compounds (thus it is unreactive with the native amino acids of naturally occurring compounds). Azides also undergo a selective ligation with a limited number of reaction partners, and azides are small and can be introduced to biological samples without altering the molecular size of significantly. One reaction that allows incorporation or introduction of azides to molecules is the copper-mediated Huisgen [3+2] cycloaddition of an azide. This reaction can be used for the selective PEGylation of peptide inhibitors. (Tornoe et al., J. Org. Chem. 67: 3057, 2002; Rostovtsev et al., Angew. Chem., Int. Ed. 41: 596, 2002; and Wang et al., J. Am. Chem. Soc. 125: 3192, 2003, Speers et al., J. Am. Chem. Soc., 2003, 125, 4686).

Illustrative Peptide Inhibitors and Peptide Dimer Inhibitors, and Methods of Making the Same The present invention thus provides various peptide inhibitors which bind or associate with IL-23, to disrupt or block binding between IL-23 and IL-23R.

Illustrative peptide inhibitors and peptide dimer inhibitors of the present invention are shown in Tables 3A-3H, 4A, 4B, 5A-5C, 6, 7, 8, 9, 10, 11, 12, 13, 14 or 15 provides the amino acid sequence of selected monomer peptide inhibitors and peptide dimer inhibitors, and indicates the linker moiety present in the peptide dimer inhibitors. According to the protocols discussed herein, a number of the peptide inhibitors and peptide dimer inhibitors shown in Tables 3A-3H, 4A, 4B, 5A-5C, 6, 7, 8, 9, 10, 11, 12, 13, 14 or 15 were synthesized. Tables 3A-3H, 4A, 4B, 5A-5C, 6, 7, 8, 9, 10, 11, 12, 13, 14 or 15 provide the IC50 values for selected monomer peptide inhibitors and peptide dimer inhibitors in inhibiting IL-23 binding to the IL-23R, or in inhibiting IL-23 signaling as determined by measuring changes in phospho-STAT3 levels, as described in the accompanying Examples.

The peptide inhibitors of the present invention may be synthesized by many techniques that are known to those skilled in the art. In certain embodiments, monomer subunits are synthesized, purified, and dimerized using the techniques described in the accompanying Examples. In certain embodiments, the present invention provides a method of producing a peptide inhibitor (or monomer subunit thereof) of the present invention, comprising chemically synthesizing a peptide comprising, consisting of, or consisting essentially of a peptide having an amino acid sequence described herein, including but not limited to any of the amino acid sequences set forth in any of Formulas I, II, III, IV, V or VI or Tables 3A-3H, 4A, 4B, 5A-5C, 6, 7, 8, 9, 10, 11, 12, 13, 14 or 15. In other embodiments, the peptide is recombinantly synthesized, instead of being chemically synthesized. In certain embodiments, the peptide inhibitor is a dimer, and the method comprises synthesizing both monomer subunits of the peptide dimer inhibitor and then dimerizing the two monomer subunits to produce the peptide dimer inhibitor. In various embodiments, dimerization is accomplished via any of the various methods described herein. In particular embodiments, methods of producing a peptide inhibitor (or monomer subunit thereof) further comprise cyclizing the peptide inhibitor (or monomer subunit thereof) after its synthesis. In particular embodiments, cyclization is accomplished via any of the various methods described herein. In certain embodiments, the present invention provides a method of producing a peptide inhibitor (or monomer subunit thereof) of the present invention, comprising introducing an intramolecular bond, e.g., a disulfide, an amide, or a thioether bond between two amino acids residues within a peptide comprising, consisting of, or consisting essentially of a peptide having an amino acid sequence described herein, including but not limited to any of the amino acid sequences set forth in any of Formulas I, II, III, IV, V or VI or Tables 3A-3H, 4A, 4B, 5A-5C, 6, 7, 8, 9, 10, 11, 12, 13, 14 or 15.

In related embodiments, the present invention includes polynucleotides that encode a polypeptide having a sequence set forth in any one of Formulas I, II, III, IV, V or VI or Tables 3A-3H, 4A, 4B, 5A-5C, 6, 7, 8, 9, 10, 11, 12, 13, 14 or 15.

In addition, the present invention includes vectors, e.g., expression vectors, comprising a polynucleotide of the present invention.

Methods of Treatment

In certain embodiments, the present invention includes methods of inhibiting IL-23 binding to an IL-23R on a cell, comprising contacting the IL-23 with a peptide inhibitor of the present invention. In certain embodiments, the cell is a mammalian cell. In particular embodiments, the method is performed in vitro or in vivo. Inhibition of binding may be determined by a variety of routine experimental methods and assays known in the art.

In certain embodiments, the present invention includes methods of inhibiting IL-23 signaling by a cell, comprising contacting the IL-23 with a peptide inhibitor of the present invention. In certain embodiments, the cell is a mammalian cell. In particular embodiments, the method is performed in vitro or in vivo. In particular embodiments, the inhibition of IL-23 signalling may be determined by measuring changes in phospho-STAT3 levels in the cell.

In some embodiments, the present invention provides methods for treating a subject afflicted with a condition or indication associated with IL-21 or IL-23R (e.g., activation of the IL-23/IL-23R signaling pathway), wherein the method comprises administering to the subject a peptide inhibitor of the present invention. In one embodiment, a method is provided for treating a subject afflicted with a condition or indication characterized by inappropriate, deregulated, or increased IL-23 or IL-23R activity or signaling, comprising administering to the individual a peptide inhibitor of the present invention in an amount sufficient to inhibit (partially or fully) binding of IL-23 to IL-23R in the subject. In particular embodiments, the inhibition of IL-23 binding to IL-23R occurs in particular organs or tissues of the subject, e.g., the stomach, small intestine, large intestine/colon, intestinal mucosa, lamina propria, Peyer's Patches, mesenteric lymph nodes, or lymphatic ducts.

In some embodiments, methods of the present invention comprise providing a peptide inhibitor of the present invention to a subject in need thereof. In particular embodiments, the subject in need thereof has been diagnosed with or has been determined to be at risk of developing a disease or disorder associated with IL-23/IL-23R. In particular embodiments, the subject is a mammal.

In certain embodiments, the disease or disorder is auto-immune inflammation and related diseases and disorders, such as multiple sclerosis, asthma, rheumatoid arthritis, inflammatory bowel diseases (IBDs), juvenile IBD, adolescent IBD, Crohn's disease, sarcoidosis, Systemic Lupus Erythematosus, ankylosing spondylitis (axial spondylarthritis), psoriatic arthritis, or psoriasis. In particular embodiments, the disease or disorder is psoriasis (e.g., plaque psoriasis, guttate psoriasis, inverse psoriasis, pustular psoriasis, Palmo-Plantar Pustulosis, psoriasis vulgaris, or erythrodermic psoriasis), atopic dermatitis, acne ectopica, ulcerative colitis, Crohn's disease, Celiac disease (nontropical Sprue), enteropathy associated with seronegative arthropathies, microscopic colitis, collagenous colitis, eosinophilic gastroenteritis/esophagitis, colitis associated with radio- or chemo-therapy, colitis associated with disorders of innate immunity as in leukocyte adhesion deficiency-1, chronic granulomatous disease, glycogen storage disease type 1b, Hermansky-Pudlak syndrome, Chediak-Higashi syndrome, Wiskott-Aldrich Syndrome, pouchitis resulting after proctocolectomy and ileoanal anastomosis, gastrointestinal cancer, pancreatitis, insulin-dependent diabetes mellitus, mastitis, cholecystitis, cholangitis, primary biliary cirrhosis, viral-associated enteropathy, pericholangitis, chronic bronchitis, chronic sinusitis, asthma, uveitis, or graft versus host disease.

In certain related embodiments, the present invention provides a method of selectively inhibiting IL-23 or IL-23R signaling (or the binding of IL-23 to IL-23R) in a subject in need thereof, comprising providing to the subject a peptide inhibitor of the present invention. In particular embodiments, the present invention includes a method of selectively inhibiting IL-23 or IL-23R signaling (or the binding of IL-23 to IL-23R) in the GI tract of a subject in need thereof, comprising providing to the subject a peptide inhibitor of the present invention by oral administration. In particular embodiments, exposure of the administered peptide inhibitor in GI tissues (e.g., small intestine or colon) is at least 10-fold, at least 20-fold, at least 50-fold, or at least 100-fold greater than the exposure in the blood. In particular embodiments, the present invention includes a method of selectively inhibiting IL23 or IL23R signaling (or the binding of IL23 to IL23R) in the GI tract of a subject in need thereof, comprising providing to the subject a peptide inhibitor, wherein the peptide inhibitor does not block the interaction between IL-6 and IL-6R or antagonize the IL-12 signaling pathway. In a further related embodiment, the present invention includes a method of inhibiting GI inflammation and/or neutrophil infiltration to the GI, comprising providing to a subject in need thereof a peptide inhibitor of the present invention. In some embodiments, methods of the present invention comprise providing a peptide inhibitor of the present invention (i.e., a first therapeutic agent) to a subject in need thereof in combination with a second therapeutic agent. In certain embodiments, the second therapeutic agent is provided to the subject before and/or simultaneously with and/or after the peptide inhibitor is administered to the subject. In particular embodiments, the second therapeutic agent is an anti-inflammatory agent. In certain embodiments, the second therapeutic agent is a non-steroidal anti-inflammatory drug, steroid, or immune modulating agent. In another embodiment, the method comprises administering to the subject a third therapeutic agent. In certain embodiments, the second therapeutic agent is an antibody that binds IL-23 or IL-23R.

In particular embodiments, the peptide inhibitor, or the pharmaceutical composition comprising a peptide inhibitor, is suspended in a sustained-release matrix. A sustained-release matrix, as used herein, is a matrix made of materials, usually polymers, which are degradable by enzymatic or acid-base hydrolysis or by dissolution. Once inserted into the body, the matrix is acted upon by enzymes and body fluids. A sustained-release matrix desirably is chosen from biocompatible materials such as liposomes, polylactides (polylactic acid), polyglycolide (polymer of glycolic acid), polylactide co-glycolide (copolymers of lactic acid and glycolic acid) polyanhydrides, poly(ortho)esters, polypeptides, hyaluronic acid, collagen, chondroitin sulfate, carboxylic acids, fatty acids, phospholipids, polysaccharides, nucleic acids, polyamino acids, amino acids such as phenylalanine, tyrosine, isoleucine, polynucleotides, polyvinyl propylene, polyvinylpyrrolidone and silicone. One embodiment of a biodegradable matrix is a matrix of one of either polylactide, polyglycolide, or polylactide co-glycolide (copolymers of lactic acid and glycolic acid).

In certain embodiments, the present invention includes pharmaceutical compositions comprising one or more peptide inhibitors of the present invention and a pharmaceutically acceptable carrier, diluent or excipient. A pharmaceutically acceptable carrier, diluent or excipient refers to a non-toxic solid, semi-solid or liquid filler, diluent, encapsulating material or formulation auxiliary of any type. Prevention of the action of microorganisms may be ensured by the inclusion of various antibacterial and antifungal agents, for example, paraben, chlorobutanol, phenol sorbic acid, and the like. It may also be desirable to include isotonic agents such as sugars, sodium chloride, and the like.

In certain embodiments, the compositions are administered orally, parenterally, intracisternally, intravaginally, intraperitoneally, intrarectally, topically (as by powders, ointments, drops, suppository, or transdermal patch), by inhalation (such as intranasal spray), ocularly (such as intraocularly) or buccally. The term "parenteral" as used herein refers to modes of administration which include intravenous, intramuscular, intraperitoneal, intrasternal, subcutaneous, intradermal and intraarticular injection and infusion. Accordingly, in certain embodiments, the compositions are formulated for delivery by any of these routes of administration.

In certain embodiments, pharmaceutical compositions for parenteral injection comprise pharmaceutically acceptable sterile aqueous or nonaqueous solutions, dispersions, suspensions or emulsions, or sterile powders, for reconstitution into sterile injectable solutions or dispersions just prior to use. Examples of suitable aqueous and nonaqueous carriers, diluents, solvents or vehicles include water, ethanol, polyols (such as glycerol, propylene glycol, polyethylene glycol, and the like), carboxymethylcellulose and suitable mixtures thereof, β-cyclodextrin, vegetable oils (such as olive oil), and injectable organic esters such as ethyl oleate. Proper fluidity may be maintained, for example, by the use of coating materials such as lecithin, by the maintenance of the required particle size in the case of dispersions, and by the use of surfactants. These compositions may also contain adjuvants such as preservative, wetting agents, emulsifying agents, and dispersing agents. Prolonged absorption of an injectable pharmaceutical form may be brought about by the inclusion of agents which delay absorption, such as aluminum monostearate and gelatin.

Injectable depot forms include those made by forming microencapsule matrices of the peptide inhibitor in one or more biodegradable polymers such as polylactide-polyglycolide, poly(orthoesters), poly(anhydrides), and (poly)glycols, such as PEG. Depending upon the ratio of peptide to polymer and the nature of the particular polymer employed, the rate of release of the peptide inhibitor can be controlled. Depot injectable formulations are also prepared by entrapping the peptide inhibitor in liposomes or microemulsions compatible with body tissues.

The injectable formulations may be sterilized, for example, by filtration through a bacterial-retaining filter, or by incorporating sterilizing agents in the form of sterile solid compositions which can be dissolved or dispersed in sterile water or other sterile injectable medium just prior to use.

Topical administration includes administration to the skin or mucosa, including surfaces of the lung and eye. Compositions for topical lung administration, including those for inhalation and intranasal, may involve solutions and suspensions in aqueous and non-aqueous formulations and can be prepared as a dry powder which may be pressurized or non-pressurized. In non-pressurized powder compositions, the active ingredient may be finely divided form may be used in admixture with a larger-sized pharmaceutically acceptable inert carrier comprising particles having a size, for example, of up to 100 micrometers in diameter. Suitable inert carriers include sugars such as lactose.

Alternatively, the composition may be pressurized and contain a compressed gas, such as nitrogen or a liquefied gas propellant. The liquefied propellant medium and indeed the total composition may be such that the active ingredient does not dissolve therein to any substantial extent. The pressurized composition may also contain a surface active agent, such as a liquid or solid non-ionic surface active agent or may be a solid anionic surface active agent. It is preferred to use the solid anionic surface active agent in the form of a sodium salt.

A further form of topical administration is to the eye. A peptide inhibitor of the invention may be delivered in a pharmaceutically acceptable ophthalmic vehicle, such that the peptide inhibitor is maintained in contact with the ocular surface for a sufficient time period to allow the peptide inhibitor to penetrate the corneal and internal regions of the eye, as for example the anterior chamber, posterior chamber, vitreous body, aqueous humor, vitreous humor, cornea, iris/ciliary, lens, choroid/retina and sclera. The pharmaceutically acceptable ophthalmic vehicle may, for example, be an ointment, vegetable oil or an encapsulating material. Alternatively, the peptide inhibitors of the invention may be injected directly into the vitreous and aqueous humor.

Compositions for rectal or vaginal administration include suppositories which may be prepared by mixing the peptide inhibitors of this invention with suitable non-irritating excipients or carriers such as cocoa butter, polyethylene glycol or a suppository wax, which are solid at room temperature but liquid at body temperature and, therefore, melt in the rectum or vaginal cavity and release the active compound.

Peptide inhibitors of the present invention may also be administered in liposomes or other lipid-based carriers. As is known in the art, liposomes are generally derived from phospholipids or other lipid substances. Liposomes are formed by mono- or multi-lamellar hydrated liquid crystals that are dispersed in an aqueous medium. Any non-toxic, physiologically acceptable and metabolizable lipid capable of forming liposomes can be used. The present compositions in liposome form can contain, in addition to a peptide inhibitor of the present invention, stabilizers, preservatives, excipients, and the like. In certain embodiments, the lipids comprise phospholipids, including the phosphatidyl cholines (lecithins) and serines, both natural and synthetic. Methods to form liposomes are known in the art.

Pharmaceutical compositions to be used in the invention suitable for parenteral administration may comprise sterile aqueous solutions and/or suspensions of the peptide inhibitors made isotonic with the blood of the recipient, generally using sodium chloride, glycerin, glucose, mannitol, sorbitol, and the like.

In some aspects, the invention provides a pharmaceutical composition for oral delivery. Compositions and peptide inhibitors of the instant invention may be prepared for oral administration according to any of the methods, techniques, and/or delivery vehicles described herein. Further, one having skill in the art will appreciate that the peptide inhibitors of the instant invention may be modified or integrated into a system or delivery vehicle that is not disclosed herein, yet is well known in the art and compatible for use in oral delivery of peptides.

In certain embodiments, formulations for oral administration may comprise adjuvants (e.g. resorcinols and/or nonionic surfactants such as polyoxyethylene oleyl ether and n-hexadecylpolyethylene ether) to artificially increase the permeability of the intestinal walls, and/or enzymatic inhibitors (e.g. pancreatic trypsin inhibitors, diisopropylfluorophosphate (DFF) or trasylol) to inhibit enzymatic degradation. In certain embodiments, the peptide inhibitor of a solid-type dosage form for oral administration can be mixed with at least one additive, such as sucrose, lactose, cellulose, mannitol, trehalose, raffinose, maltitol, dextran, starches, agar, alginates, chitins, chitosans, pectins, gum tragacanth, gum arabic, gelatin, collagen, casein, albumin, synthetic or semisynthetic polymer, or glyceride. These dosage forms can also contain other type(s) of additives, e.g., inactive diluting agent, lubricant such as magnesium stearate, paraben, preserving agent such as sorbic acid, ascorbic acid, alpha-tocopherol, antioxidants such as cysteine, disintegrators, binders, thickeners, buffering agents, pH adjusting agents, sweetening agents, flavoring agents or perfuming agents.

In particular embodiments, oral dosage forms or unit doses compatible for use with the peptide inhibitors of the present invention may include a mixture of peptide inhibitor and nondrug components or excipients, as well as other non-reusable materials that may be considered either as an ingredient or packaging. Oral compositions may include at least one of a liquid, a solid, and a semi-solid dosage forms. In some embodiments, an oral dosage form is provided comprising an effective amount of peptide inhibitor, wherein the dosage form comprises at least one of a pill, a tablet, a capsule, a gel, a paste, a drink, a syrup, ointment, and suppository. In some instances, an oral dosage form is provided that is designed and configured to achieve delayed release of the peptide inhibitor in the subject's small intestine and/or colon.

In one embodiment, an oral pharmaceutical composition comprising a peptide inhibitor of the present invention comprises an enteric coating that is designed to delay release of the peptide inhibitor in the small intestine. In at least some embodiments, a pharmaceutical composition is provided which comprises a peptide inhibitor of the present invention and a protease inhibitor, such as aprotinin, in a delayed release pharmaceutical formulation. In some instances, pharmaceutical compositions of the instant invention comprise an enteric coat that is soluble in gastric juice at a pH of about 5.0 or higher. In at least one embodiment, a pharmaceutical composition is provided comprising an enteric coating comprising a polymer having dissociable carboxylic groups, such as derivatives of cellulose, including hydroxypropylmethyl cellulose phthalate, cellulose acetate phthalate and cellulose acetate trimellitate and similar derivatives of cellulose and other carbohydrate polymers.

In one embodiment, a pharmaceutical composition comprising a peptide inhibitor of the present invention is provided in an enteric coating, the enteric coating being designed to protect and release the pharmaceutical composition in a controlled manner within the subject's lower gastrointestinal system, and to avoid systemic side effects. In addition to enteric coatings, the peptide inhibitors of the instant invention may be encapsulated, coated, engaged or otherwise associated within any compatible oral drug delivery system or component. For example, in some embodiments a peptide inhibitor of the present invention is provided in a lipid carrier system comprising at least one of polymeric hydrogels, nanoparticles, microspheres, micelles, and other lipid systems.

To overcome peptide degradation in the small intestine, some embodiments of the present invention comprise a hydrogel polymer carrier system in which a peptide inhibitor of the present invention is contained, whereby the hydrogel polymer protects the peptide inhibitor from proteolysis in the small intestine and/or colon. The peptide inhibitors of the present invention may further be formulated for compatible use with a carrier system that is designed to increase the dissolution kinetics and enhance intestinal absorption of the peptide. These methods include the use of liposomes, micelles and nanoparticles to increase GI tract permeation of peptides.

Various bioresponsive systems may also be combined with one or more peptide inhibitor of the present invention to provide a pharmaceutical agent for oral delivery. In some embodiments, a peptide inhibitor of the instant invention is used in combination with a bioresponsive system, such as hydrogels and mucoadhesive polymers with hydrogen bonding groups (e.g., PEG, poly(methacrylic) acid [PMAA], cellulose, Eudragit®, chitosan and alginate) to provide a therapeutic agent for oral administration. Other embodiments include a method for optimizing or prolonging drug residence time for a peptide inhibitor disclosed herein, wherein the surface of the peptide inhibitor surface is modified to comprise mucoadhesive properties through hydrogen bonds, polymers with linked mucins or/and hydrophobic interactions. These modified peptide molecules may demonstrate increase drug residence time within the subject, in accordance with a desired feature of the invention. Moreover, targeted mucoadhesive systems may specifically bind to receptors at the enterocytes and M-cell surfaces, thereby further increasing the uptake of particles containing the peptide inhibitor.

Other embodiments comprise a method for oral delivery of a peptide inhibitor of the present invention, wherein the peptide inhibitor is provided to a subject in combination with permeation enhancers that promote the transport of the peptides across the intestinal mucosa by increasing paracellular or transcellular permeation. For example, in one embodiment, a permeation enhancer is combined with a peptide inhibitor, wherein the permeation enhancer comprises at least one of a long-chain fatty acid, a bile salt, an amphiphilic surfactant, and a chelating agent. In one embodiment, a permeation enhancer comprising sodium N-[hydroxybenzoyl)amino]caprylate is used to form a weak noncovalent association with the peptide inhibitor of the instant invention, wherein the permeation enhancer favors membrane transport and further dissociation once reaching the blood circulation. In another embodiment, a peptide inhibitor of the present invention is conjugated to oligoarginine, thereby increasing cellular penetration of the peptide into various cell types. Further, in at least one embodiment a noncovalent bond is provided between a peptide inhibitor of the present invention and a permeation enhancer selected from the group consisting of a cyclodextrin (CD) and a dendrimers, wherein the permeation enhancer reduces peptide aggregation and increasing stability and solubility for the peptide inhibitor molecule.

Other embodiments of the invention provide a method for treating a subject with a peptide inhibitor of the present invention having an increased half-life. In one aspect, the present invention provides a peptide inhibitor having a half-life of at least several hours to one day in vitro or in vivo (e.g., when administered to a human subject) sufficient for daily (q.d.) or twice daily (b.i.d.) dosing of a therapeutically effective amount. In another embodiment, the peptide inhibitor has a half-life of three days or longer sufficient for weekly (q.w.) dosing of a therapeutically effective amount. Further, in another embodiment, the peptide inhibitor has a half-life of eight days or longer sufficient for bi-weekly (b.i.w.) or monthly dosing of a therapeutically effective amount. In another embodiment, the peptide inhibitor is derivatized or modified such that is has a longer half-life as compared to the underivatized or unmodified peptide inhibitor. In another embodiment, the peptide inhibitor contains one or more chemical modifications to increase serum half-life.

When used in at least one of the treatments or delivery systems described herein, a peptide inhibitor of the present invention may be employed in pure form or, where such forms exist, in pharmaceutically acceptable salt form.

The total daily usage of the peptide inhibitors and compositions of the present invention can be decided by the attending physician within the scope of sound medical judgment. The specific therapeutically effective dose level for any particular subject will depend upon a variety of factors including: a) the disorder being treated and the severity of the disorder; b) activity of the specific compound employed; c) the specific composition employed, the age, body weight, general health, sex and diet of the patient; d) the time of administration, route of administration, and rate of excretion of the specific peptide inhibitor employed; e) the duration of the treatment; f) drugs used in combination or coincidental with the specific peptide inhibitor employed, and like factors well known in the medical arts.

In particular embodiments, the total daily dose of the peptide inhibitors of the invention to be administered to a human or other mammal host in single or divided doses may be in amounts, for example, from 0.0001 to 300 mg/kg body weight daily or 1 to 300 mg/kg body weight daily.

Non-Invasive Detection of Intestinal Inflammation

The peptide inhibitors of the invention may be used for detection, assessment and diagnosis of intestinal inflammation by microPET imaging, wherein the peptide inhibitor is labeled with a chelating group or a detectable label, as part of a non-invasive diagnostic procedure. In one embodiment, a peptide inhibitor is conjugated with a bifunctional chelator. In another embodiment, a peptide inhibitor is radiolabeled. The labeled peptide inhibitor is then administered to a subject orally or rectally. In one embodiment, the labeled peptide inhibitor is included in drinking water. Following uptake of the peptide inhibitor, microPET imaging may be used to visualize inflammation throughout the subject's bowels and digestive track.

Identification of Peptide Inhibitors that Inhibit IL-23 Signalling

As described herein, in certain embodiments, peptide inhibitors of the present invention preferentially bind to human IL-23R and/or rat IL-23R as compared to mouse IL-23R. Mouse IL-23R contains additional amino acids as compared to human IL-23R or rat IL-23R in the region corresponding to about amino acid residue 315 to about amino acid residue 340 of the mouse IL23R protein, e.g., amino acid region NWQPWSSPFVHQTSQETGKR (SEQ ID NO: 261) (see, e.g., FIG. 4). In particular embodiments, the peptide inhibitors bind to a region of human IL-23R from about amino acid 230 to about amino acid residue 370.

The present invention provides a new method to identify an inhibitor (e.g., a peptide inhibitor) of IL-23R, based on identifying an agent (e.g., a peptide) that preferentially binds to human IL-23R or rat IL-23R as compared to mouse IL-23R. In certain embodiments, the method comprises: (a) determining an amount of binding of a candidate agent to a human IL-23R polypeptide or a rat IL-23R polypeptide; (b) determining an amount of binding of the candidate agent to the mouse IL-23R polypeptide; and (c) comparing the determined amount of binding to the human IL-23R polypeptide or the rat IL-23R polypeptide to the determined amount of binding to the mouse IL-23R polypeptide, wherein if the determined amount of binding to the human IL-23R polypeptide or the rat IL-23R polypeptide is greater than the amount of binding to the mouse IL-23R polypeptide, the candidate compound is an inhibitor of IL-23R. In particular embodiments, the candidate compound is identified as an inhibitor of IL-23R if the determined amount of binding to the human IL-23R polypeptide or the rat IL-23R polypeptide is at least 1.5-fold, at least 2-fold, at least 3-fold, at least 4-fold, at least 5-fold, at least 10-fold, at least 20-fold, at least 30-fold, at least 40-fold, at least 50-fold, at least 100-fold, at least 200-fold, at least 500-fold, or at least 100-fold the determined amount of binding to the mouse IL-23R polypeptide. In particular embodiments, the candidate compound is a peptide. In particular embodiments, the peptide is a peptide of one of the formulas described herein. In particular embodiments, the human IL-23 polypeptide or rat IL-23R polypeptide comprises or consists of the full length human IL-23R or rat IL-23R protein, respectively. In other embodiments, the human IL-23R polypeptide is a fragment of the full length human IL-23R protein, comprising 8 or more amino acid residues within the region of human IL-23R from about amino acid residue 230 to about amino acid residue 370. In other embodiments, the rat IL-23R polypeptide is a fragment of the full length rat IL-23R protein, comprising 8 or more amino acid residues within the region of rat IL-23R from about amino acid residue 245 to about amino acid residue 385.

Figure 4:
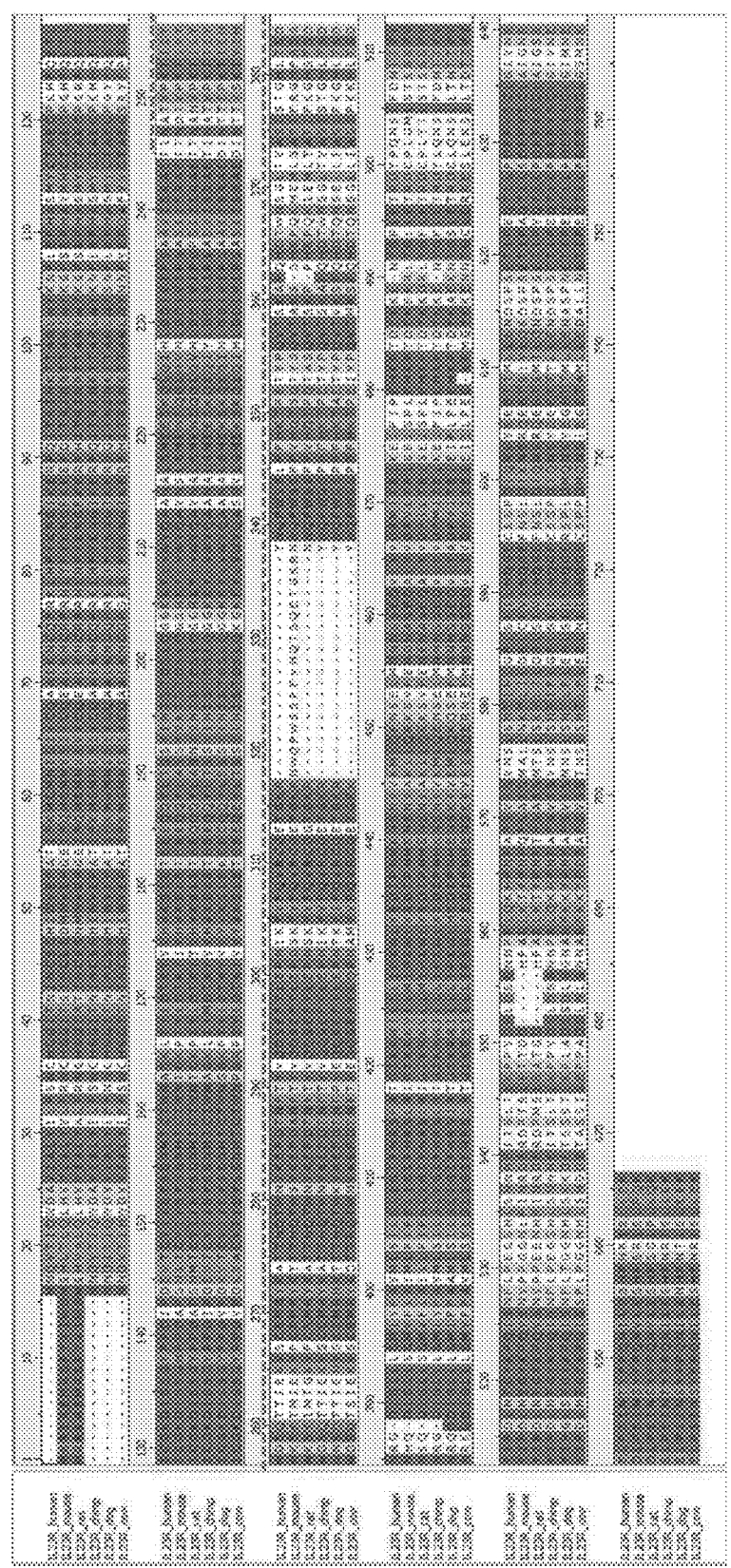
FIG. 4 shows an alignment of the amino acid sequences of human IL23R (SEQ ID NO: 760), mouse IL-23R (SEQ ID NO: 761), rat IL23R (SEQ ID NO: 762), chimp IL-23R (SEQ ID NO: 763), dog IL-23R (SEQ ID NO: 764) and cow IL-23R (SEQ ID NO: 765), with highly conserved amino acid residues shaded. The region of mouse IL-23R lacking in the other IL-23R species shown is shown, and a region of IL23R that may be bound by certain peptide inhibitors of the present invention is indicated by a dashed line.
Figure 6A:
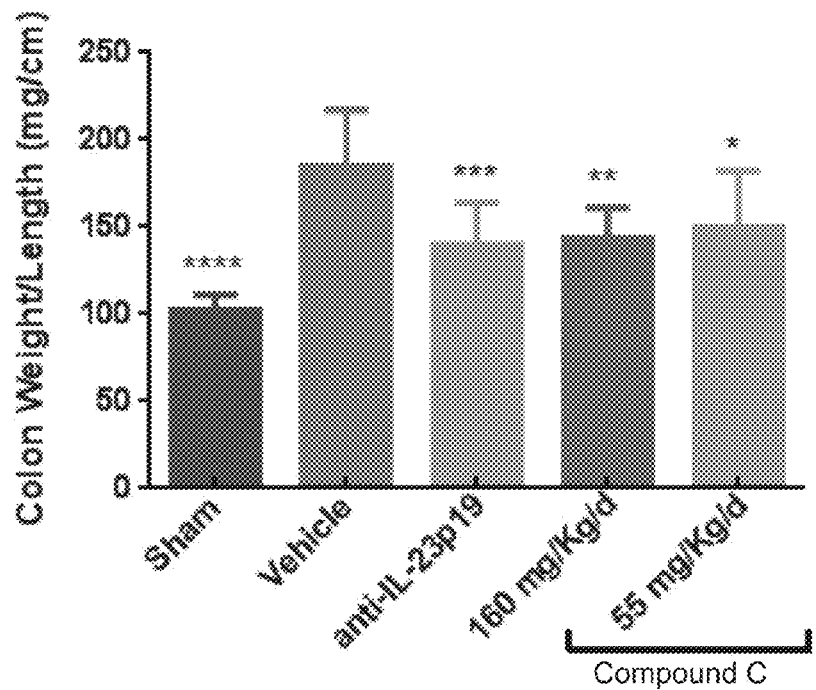
FIGS. 6A-6D are graphs showing colon weight to length (FIG. 6A), colon wall thickness (Table 6B, colon macroscopic score (Table 6C) or myeloperoxidase (MPO) abundance in proximal colon extracts quantified by ELISA, following sham treatment, vehicle treatment, or treatment with the indicated amounts of anti-IL23p19 antibody or Compound C. Values are shown as mean±SD. Statistical significance assessed by one-way ANOVA: *≤0.05; ≤0.01; *p≤0.001; ****p≤0.0001; ns, not significant.
Figure 6B:
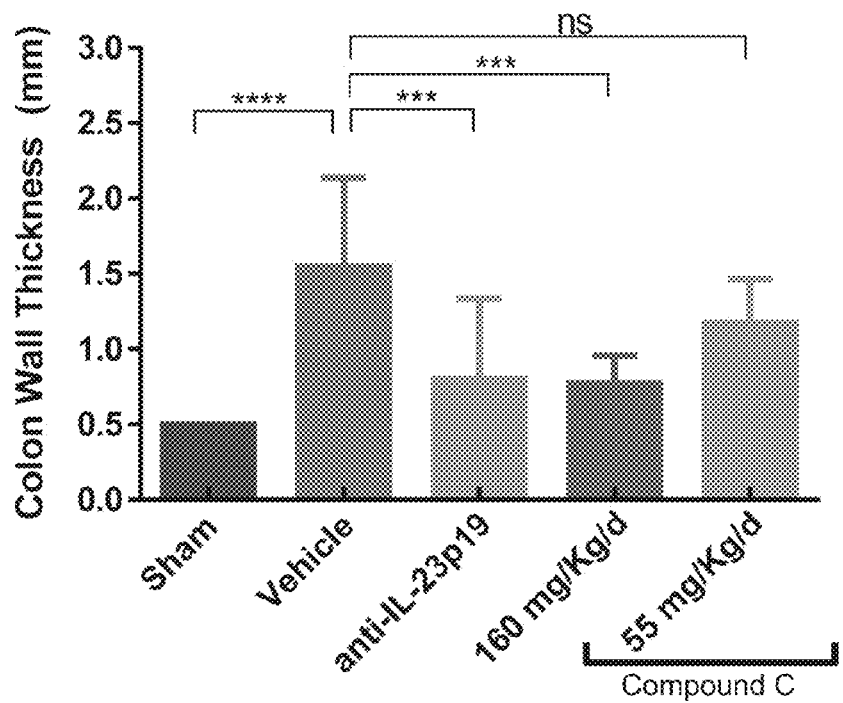
Figure 6C:
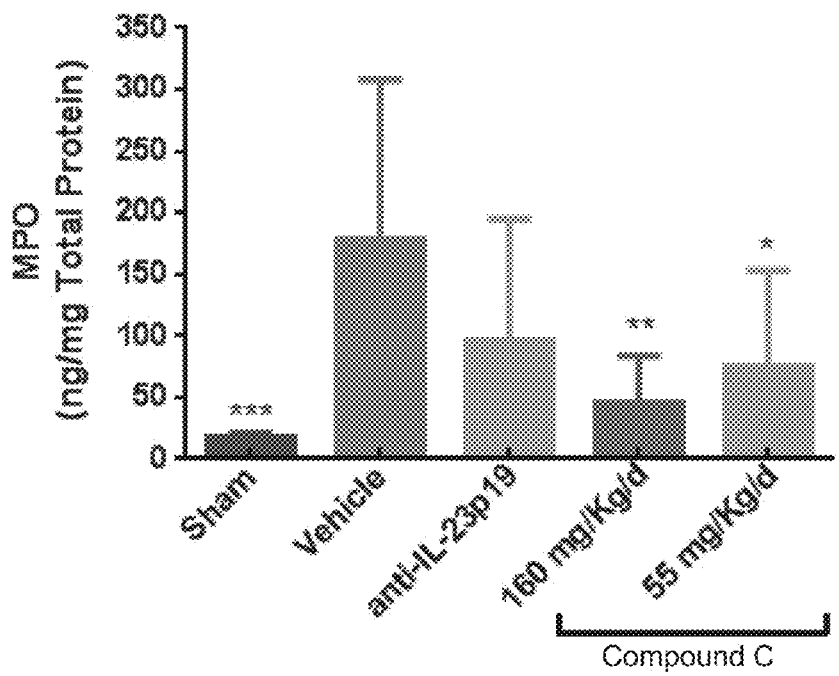
Figure 6D:
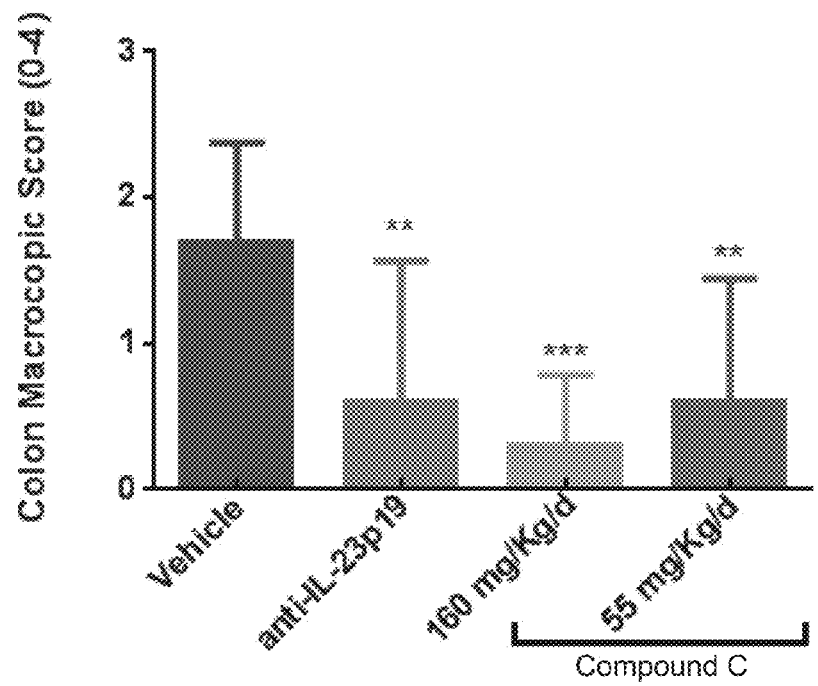

In another embodiment, the present invention provides a new method to identify an inhibitor (e.g., a peptide inhibitor) of IL-23R, based on identifying an agent that binds to a region of human IL-23R or rat IL-23 that is disrupted in mouse IL-23R by the presence of additional amino acids from about amino acid residues 315 to about amino acid residue 340 of the mouse IL23R protein, e.g., amino acid region NWQPWSSPFVHQTSQETGKR (see, e.g., FIG. 4). In certain embodiments, the method comprises: (a) determining an amount of binding of a candidate agent to a fragment of human IL-23R polypeptide that falls within about amino acid residue 230 to about amino acid residue 370, or to a fragment of rat IL-23R polypeptide that falls within about amino acid residue 245 to about amino acid residue 385; (b) determining an amount of binding of the candidate agent to a negative control (e.g., a negative control peptide unrelated to human IL-23R or rat-IL-23R); and (c) comparing the determined amount of binding to the fragment of human IL-23R polypeptide or the fragment of rat IL-23R polypeptide to the determined amount of binding to the negative control, wherein if the determined amount of binding to the human IL-23R polypeptide fragment or the rat IL-23R polypeptide fragment is greater than the amount of binding to the negative control, the candidate compound is an inhibitor of IL-23R. In particular embodiments, the candidate compound is identified as an inhibitor of IL-23R if the determined amount of binding to the human IL-23R polypeptide fragment or the rat IL-23R polypeptide fragment is at least 1.5-fold, at least 2-fold, at least 3-fold, at least 4-fold, at least 5-fold, at least 10-fold, at least 20-fold, at least 30-fold, at least 40-fold, at least 50-fold, at least 100-fold, at least 200-fold, at least 500-fold, or at least 100-fold the determined amount of binding to the negative control. In particular embodiments, the candidate compound is a peptide. In particular embodiments, the peptide is a peptide of one of the formulas described herein. In particular embodiments, the fragment of human IL-23R includes at least 8, at least 12, at least 20, at least 50, or at least 100, or all amino acid residues within the region of human IL-23R from about amino acid residue 230 to about amino acid residue 370. In other embodiments, the fragment of rat IL-23R polypeptide includes at least 8, at least 12, at least 20, at least 50, or at least 100, or all amino acid residues within the region of rat IL-23R from about amino acid residue 245 to about amino acid residue 385.

Methods of determining binding of a candidate compound to an IL-23 polypeptide are known in the art and include but are not limited to in vitro and cell-based binding assays, including those described herein. For example, a labeled candidate compound may be incubated with a recombinantly produced IL-23R polypeptide or negative control bound to a solid support under conditions and for a time sufficient to allow binding, and then binding determined by measuring the amount of label associated with the bound IL-23R polypeptide.

Non-Invasive Detection of Intestinal Inflammation

The peptide inhibitors of the invention may be used for detection, assessment and diagnosis of intestinal inflammation by microPET imaging, wherein the peptide inhibitor is labeled with a chelating group or a detectable label, as part of a non-invasive diagnostic procedure. In one embodiment, a peptide inhibitor is conjugated with a bifunctional chelator. In another embodiment, a peptide inhibitor is radiolabeled. The labeled peptide inhibitor is then administered to a subject orally or rectally. In one embodiment, the labeled peptide inhibitor is included in drinking water. Following uptake of the peptide inhibitor, microPET imaging may be used to visualize inflammation throughout the subject's bowels and digestive track.

Animal Models of IBD

The present invention includes models of animal disease, including inflammatory diseases and disorders, such as inflammatory bowel diseases, e.g., Crohn's disease and colitis. As described in the accompanying Examples, several animal models of inflammatory diseases and disorders were developed.

In one embodiment, the present invention includes a method of assessing the ability of a candidate compound to inhibit or reduce an inflammatory disease disorder, comprising:

(a) providing to a rat an amount of dextran sulfate sodium (DSS) sufficient to induce IBD;
(b) providing to the rat an amount of a candidate compound; and
(c) measuring an amount of IBD symptoms present in the rat after being provided with the DSS and the candidate compound;
wherein if the amount of IBD symptoms measured in (c) are significantly lower than the amount measured in a control rat provided with the amount of DSS and either an amount of a control compound or no peptide (e.g., vehicle control), the candidate compound inhibits or reduces the inflammatory disease or disorder.

In certain embodiments, the rat is provided with DSS for about 5 to 12 days, e.g., about 9 days. In particular embodiments, the rat is provided with DSS by providing to the rat ad lib exposure to drinking water containing DSS, e.g., about 1% to about 10% DSS, about 2% to about 5% DSS, or about 3% DSS. In particular embodiments, the rat is provided with the test compound at about 5 mg/kg to about 100 mg/kg, or about 10 mg/kg to about 50 mg/kg, or about 20 mg/kg or about 30 mg/kg. In particular embodiments, the rat is provided with test compound orally, e.g., in drinking water. In certain embodiments, the DSS assay is performed as described in the accompanying Examples.

In another embodiment, the present invention includes a method of assessing the ability of a candidate compound to inhibit or reduce an inflammatory disease disorder, comprising:
(a) providing to a rat an amount of 2,4,6-Trinitrobenzenesulfonic acid (TNBS) sufficient to induce IBD;
(b) providing to the rat an amount of a candidate compound; and
(c) measuring an amount of IBD symptoms present in the rat after being provided with the TNBS and the candidate compound;
wherein if the amount of IBD symptoms measured in (c) are significantly lower than the amount measured in a control rat provided with the amount of TNBS and either an amount of a control compound or no peptide (e.g., vehicle control), the candidate compound inhibits or reduces the inflammatory disease or disorder.

In certain embodiments, the animals are provided with about 10 mg/kg to about 200 mg/kg TNBS, e.g., about 10 mg/kg, about 20 mg/kg, about 30 mg/kg, about 40 mg/kg, about 50 mg/kg, about 60 mg/kg, about 70 mg/kg, about 80 mg/kg, about 90 mg/kg, about 100 mg/kg, about 120 mg/kg, about 150 mg/kg or about 200 mg/kg of TNBS. In certain embodiments, the TNBS is in alcohol, e.g., in 45%-50% ethanol. In particular embodiments, the TNBS is administered intrarectally. In particular embodiments, the rat is provided with the test compound at about 5 mg/kg to about 100 mg/kg, or about 10 mg/kg to about 50 mg/kg, or about 20 mg/kg or about 30 mg/kg. In particular embodiments, the rat is provided with the test compound orally, e.g., in drinking water. In certain embodiments, the TNBS assay is performed as described in the accompanying Examples.

In particular embodiments IBD symptoms are measured immediately following provision of the DSS or TNBS and candidate compound (or test compound or no compound), or later, e.g., at about 3 days, 5 days, or 9 days following initial provision of DSS or TNBS and candidate compound (or test compound or no compound). In particular embodiments, the IBD symptoms measured include one or more of percent body weight loss, stool consistency, a quantitative hemoccult score, and ratio of colon weight:colon length. In certain embodiments, the IBD symptoms are measured using a disease activity index (DAI) score and/or ratio of colon weight:colon length, wherein the DAI score consists of ratings from three parameters, including percent body weight loss, stool consistency, and a quantitative hemoccult score, and can achieve a maximum of three units.

In certain embodiments, a neutralizing anti-IL-23p19 antibody is used as a comparator or positive control.

In certain embodiments, to assess the extent of the inflammatory response, animals are observed, e.g., daily, for clinical signs which included percent body weight loss and signs of loose stools or diarrhea. Following a time period after inoculation of with DSS or TNBS (e.g., 5 days, 6, days, or seven days), rats are sacrificed and their entire colon length and colon weight from cecum to rectum recorded. The severity of colitis may be evaluated by a pathologist blinded to the identity of treatments. In addition to the colon wall thickness, the gross colon damage may be assessed based on a 0-4 scale according to Table 19 below, and histopathological scores were determined based on below parameters (Tables 20 and 21).

In certain embodiments, IBD symptoms are measured in three groups of rats, each with at least 3 animals, e.g., six animals each, wherein the three groups include: vehicle, DSS or TNBS, and DSS or TNBS with a positive control (e.g., sulfasalazine administered at 100 mg/kg PO, QD).

EXAMPLES

Example 1

Synthesis of Peptide Monomers

Peptide monomers of the present invention were synthesized using the Merrifield solid phase synthesis techniques on Protein Technology's Symphony multiple channel synthesizer. The peptides were assembled using HBTU (O-Benzotriazole-N,N,N',N'-tetramethyl-uronium-hexafluorophosphate), Diisopropylethylamine (DIEA) coupling conditions. For some amino acid couplings PyAOP(7-Azabenzotriazol-1-yloxy)tripyrrolidinophosponium hexafluorophosphate) and DIEA conditions were used. Rink Amide MBHA resin (100-200 mesh, 0.57 mmol/g) was used for peptide with C-terminal amides and pre-loaded Wang Resin with N-α-Fmoc protected amino acid was used for peptide with C-terminal acids. The coupling reagents (HBTU and DIEA premixed) were prepared at 100 mmol concentration. Similarly amino acids solutions were prepared at 100 mmol concentration. Peptide inhibitors of the present invention were identified based on medical chemistry optimization and/or phage display and screened to identify those having superior binding and/or inhibitory properties.

Assembly

The peptides were assembled using standard Symphony protocols. The peptide sequences were assembled as follows: Resin (250 mg, 0.14 mmol) in each reaction vial was washed twice with 4 ml of DMF followed by treatment with 2.5 ml of 20% 4-methyl piperidine (Fmoc deprotection) for 10 min. The resin was then filtered and washed two times with DMF (4 ml) and re-treated with N-methyl piperidine for additional 30 minute. The resin was again washed three times with DMF (4 ml) followed by addition 2.5 ml of amino acid and 2.5 ml of HBTU-DIEA mixture. After 45 min of frequent agitations, the resin was filtered and washed three timed with DMF (4 ml each). For a typical peptide of the present invention, double couplings were performed. After completing the coupling reaction, the resin was washed three times with DMF (4 ml each) before proceeding to the next amino acid coupling.

Ring Closing Metathesis to Form Olefins

The resin (100 µmol) was washed with 2 ml of DCM (3×1 min) and then with 2 ml of DCE (3×1 min) before being treated with a solution of 2 ml of a 6 mM solution of Grubbs' first-generation catalyst in DCE (4.94 mg ml-1; 20 mol % with regard to the resin substitution). The solution was refluxed overnight (12 h) under nitrogen before being drained. The resin was washed three times with DMF (4 ml each); DCM (4 ml) before being dried and cleaved.

Cleavage

Following completion of the peptide assembly, the peptide was cleaved from the resin by treatment with cleavage reagent, such as reagent K (82.5% trifluoroacetic acid, 5% water, 5% thioanisole, 5% phenol, 2.5% 1,2-ethanedithiol). The cleavage reagent was able to successfully cleave the peptide from the resin, as well as all remaining side chain protecting groups.

The cleaved peptides were precipitated in cold diethyl ether followed by two washings with ethyl ether. The filtrate was poured off and a second aliquot of cold ether was added, and the procedure repeated. The crude peptide was dissolved in a solution of acetonitrile:water (7:3 with 1% TFA) and filtered. The quality of linear peptide was then verified using electrospray ionization mass spectrometry (ESI-MS) (Micromass/Waters ZQ) before being purified.

Disulfide Bond Formation Via Oxidation

The peptide containing the free thiol (for example diPen) was assembled on a Rink Amide-MBHA resin following general Fmoc-SPPS procedure. The peptide was cleaved from the resin by treatment with cleavage reagent 90% trifluoroacetic acid, 5% water, 2.5% 1,2-ethanedithiol, 2.5% tri-isopropylsilane). The cleaved peptides were precipitated in cold diethyl ether followed by two washings with ethyl ether. The filtrate was poured off and a second aliquot of cold ether was added, and the procedure repeated. The crude peptide was dissolved in a solution of acetonitrile:water (7:3 with 1% TFA) and filtered giving the wanted unoxidized peptide crude peptide The crude, cleaved peptide with X4 and X9 possessing either Cys, Pen, hCys, (D)Pen, (D)Cys or (D)hCys, was dissolved in 20 ml of water:acetonitrile. Saturated Iodine in acetic acid was then added drop wise with stirring until yellow color persisted. The solution was stirred for 15 minutes, and the reaction was monitored with analytic HPLC and LCMS. When the reaction was completed, solid ascorbic acid was added until the solution became clear. The solvent mixture was then purified by first being diluted with water and then loaded onto a reverse phase HPLC machine (Luna C18 support, 10 u, 100 A, Mobile phase A: water containing 0.1% TFA, mobile phase B: Acetonitrile (ACN) containing 0.1% TFA, gradient began with 5% B, and changed to 50% B over 60 minutes at a flow rate of 15 ml/min). Fractions containing pure product were then freeze-dried on a lyophilizer.

Lactam Bond Formation 100 mg of crude, cleaved peptide (approx. 0.12 mmol) is dissolved in 100 ml of anhydrous dichloromethane. HOBt (1-Hydroxybenzotriazole hydrate) (0.24 mmol, 2 equivalents) is added followed by DIEA (N,N-Diisopropylethylamine) (1.2 mmol, 10 equivalents) and TBTU (0-(Benzotriazol-1-yl)-N,N,N',N'-tetramethyluronium tetrafluoroborate)(0.24 mmol, 2 equivalents). The mixture is stirred overnight and followed the reaction by HPLC. When the reaction is completed, dichloromethane is evaporated and diluted with water and Acetonitrile and then loaded onto a reverse phase HPLC machine (Luna C18 support, 10 u, 100 A, Mobile phase A: water containing 0.1% TFA, mobile phase B: Acetonitrile (ACN) containing 0.1% TFA, gradient begins with 5% B, and is changed to 50% B over 60 minutes at a flow rate of 15 ml/min). Fractions containing pure product are then freeze-dried on a lyophilizer.

Triazole Bond Formation

The purified peptide containing the relevant amino acids alkyne and azide was stirred at room temperature in a phosphate/MeOH (2:1) at pH 7.4 (1 mg per 2 ml). $CuSO4.5H_2O$ (10 equiv.), and sodium ascorbate (10 equiv.) was added and the mixture was agitated in at room temperature for 36 h. MeOH was removed and the solution was acidified to pH 3 with 1% TFA water mix. The solution was then filtered before being loaded onto HPLC for peptide purification.

Thioether Bond Formation

The peptide containing the free thiol (eg Cys) and hSer (OTBDMS) was assembled on a Rink Amide-MBHA resin following general Fmoc-SPPS procedure. Chlorination was carried out by treating the resin with $PPh_3$ (10 equiv.) and $Cl_3CCN$ (10 equiv.) in DCM for 2 h. The peptide was cleaved from the resin by treatment with cleavage reagent 90% trifluoroacetic acid, 5% water, 2.5% 1,2-ethanedithiol, 2.5% tri-isopropylsilane). The cleaved peptides were precipitated in cold diethyl ether followed by two washings with ethyl ether. The filtrate was poured off and a second aliquot of cold ether was added, and the procedure repeated. The crude peptide was dissolved in a solution of acetonitrile:water (7:3 with 1% TFA) and filtered giving the wanted uncyclized crude peptide The crude peptide possessing a free thiol (eg Cys, Pen, hCys, (D)Pen, (D)Cys or (D)hCys) and the alkyl halide (hSer(Cl)) at either the X4 and X9 position or X9 and X4 position was dissolved in 0.1 M TRIS buffer pH 8.5. Cyclization was allowed to take place overnight at RT. The solvent mixture was then purified by first being diluted two-fold with water and then loaded onto a reverse phase HPLC machine (Luna C18 support, 10 u, 100 A, Mobile phase A: water containing 0.1% TFA, mobile phase B: Acetonitrile (ACN) containing 0.1% TFA, gradient began with 5% B, and changed to 50% B over 60 minutes at a flow rate of 15 ml/min). Fractions containing pure product were then freeze-dried on a lyophilizer.

Selenoether Bond Formation

Crude peptide containing the thiol protected-Selenium amino acid and the alkyl halide at X4 and X9 was dissolved in 0.1 M sodium phosphate buffer pH 5.5 containing DTT (40 equ.). Cyclization was allowed to take place over 24 h at RT. The solution was then diluted two-fold with water, and the final cyclized peptide was purified using RP-HPLC, affording the selenoether.

Diselenide Bond Formation

Diselenide precursor was dissolved in a solution of 0.1 M phosphate buffer pH 6.0 and isopropanol containing DTT (40 equiv), and the reaction mixture was incubated at 37° C. After 20 h, additional DTT (10 equiv) was added to the reaction. After a total of 32 h, the cyclization reaction was then diluted with twofold water, and the final cyclized peptide was purified using RP-HPLC, affording the diselenide.

Purification

Analytical reverse-phase, high performance liquid chromatography (HPLC) was performed on a Gemini C18 column (4.6 mm×250 mm) (Phenomenex). Semi-Preparative reverse phase HPLC was performed on a Gemini 10 μm C18 column (22 mm×250 mm) (Phenomenex) or Jupiter 10 μm, 300 A o C18 column (21.2 mm×250 mm) (Phenomenex). Separations were achieved using linear gradients of buffer B in A (Mobile phase A: water containing 0.15% TFA, mobile phase B: Acetonitrile (ACN) containing 0.1% TFA), at a flow rate of 1 mL/min (analytical) and 15 mL/min (preparative). Separations were achieved using linear gradients of buffer B in A (Mobile phase A: water containing 0.15% TFA, mobile phase B: Acetonitrile (ACN) containing 0.1% TFA), at a flow rate of 1 mL/min (analytical) and 15 mL/min (preparative).

Linker Activation and Dimerization

Peptide monomer subunits were linked to form peptide dimer inhibitors as described below.

Small Scale DIG Linker Activation Procedure:

5 mL of NMP was added to a glass vial containing IDA diacid (304.2 mg, 1 mmol), N-hydroxysuccinimide (NHS, 253.2 mg, 2.2 eq. 2.2 mmol) and a stirring bar. The mixture was stirred at room temperature to completely dissolve the solid starting materials. N,N'-Dicyclohexylcarbodiimide (DCC, 453.9 mg, 2.2 eq., 2.2 mmol) was then added to the mixture. Precipitation appeared within 10 min and the reaction mixture was further stirred at room temperature overnight. The reaction mixture was then filtered to remove the precipitated dicyclohexylurea (DCU). The activated linker was kept in a closed vial prior to use for dimerization. The nominal concentration of the activated linker was approximately 0.20 M.

For dimerization using PEG linkers, there is no pre-activation step involved. Commercially available pre-activated bi-functional PEG linkers were used.

Dimerization Procedure:

2 mL of anhydrous DMF was added to a vial containing peptide monomer (0.1 mmol). The pH of the peptide was the adjusted to 8-9 with DIEA. Activated linker (IDA or PEG13, PEG 25) (0.48 eq relative to monomer, 0.048 mmol) was then added to the monomer solution. The reaction mixture was stirred at room temperature for one hour. Completion of the dimerization reaction was monitored using analytical HPLC. The time for completion of dimerization reaction varied depending upon the linker. After completion of reaction, the peptide was precipitated in cold ether and centrifuged. The supernatant ether layer was discarded. The precipitation step was repeated twice. The crude dimer was then purified using reverse phase HPLC (Luna C18 support, 10 u, 100 A, Mobile phase A: water containing 0.1% TFA, mobile phase B: Acetonitrile (ACN) containing 0.1% TFA, gradient of 15% B and change to 45% B over 60 min, flow rate 15 ml/min). Fractions containing pure product were then freeze-dried on a lyophilizer.

Example 2

Characterization of Peptide Inhibition of Binding of Interleukin-23 to the Interleukin-23 Receptor Peptide optimization was performed to identify peptide inhibitors of IL-23 signalling that were active at low concentrations (e.g., IC50<10 nM) while exhibiting gastrointestinal (GI) stability. Certain peptides were tested to identify peptides that inhibit the binding of IL-23 to human IL-23R and inhibit IL-23/IL-23R functional activity, as described below. Peptides tested included peptides containing a variety of different cyclization chemistries, including, e.g., cyclic amides (side chain cyclizations), peptides containing a disulfide linkage, e.g., between two Pen residues, and peptides containing a thioether linkage. Peptide inhibitors of the present invention include but are not limited to peptides having any of the structures depicted herein. In addition, peptide inhibitors of the present invention include those having the same amino acid sequence of the peptides or structures described herein, without being required to have the same or any N- or C-terminal "capping" groups, such as, e.g., Ac or $NH_2$.

Assays performed to determine peptide activity are described below, and the results of these assays is provided in Tables 3A-3H, 4A and 4B, 5A-5C, 6, 7, and 8. Human ELISA indicates the IL23-IL23R competitive binding assay described below, Rat ELISA indicates the rat IL-23R competitive binding ELISA assay described below, and pStat3HTRF indicates the DB cells IL-23R pSTAT3 cell assay described below. The peptides depicted in Tables 3B-3E are cyclized via a disulfide bridge formed between two cysteine residues in these peptides. The peptides depicted in Table 3F are dimerized via a linker moiety or through internal cysteine moieties, as indicated. The peptides depicted in Tables 4A and 4B are cyclized via the two Pen residues present in each of these peptides. The peptides depicted in Table 5A are cyclized via a thioether bond between the indicated amino acid residues. Table 5B provides an illustrative structure depicting thioether cyclization, which is indicated in the table by the term "Cyclo," with the cyclic region bracketed immediately following. The monomer subunits of the peptide dimers shown in Table 5C are cyclized as indicated by the term "Cyclo" and linked to each other via the indicated linker. The peptides shown in Table 6 are cyclized via ring closing metathesis of the indicated residues. Table 7 provides two illustrative structures depicting side chain cyclizations via cyclic amides, and the peptides in this table are cyclized as indicated following the term "Cyclo." Table 8 depicts peptides cyclized via a cysteine residue and a Pen residue.

Peptide inhibitors of the present invention include both the cyclized form of the peptides shown herein, as well as the non-cyclized forms. For certain peptides, the residue Abu is present where indicated, whereas in other embodiments related to the non-cyclized form, the Abu may be referred to as a hSer(C1) or homoSer residue.

IL23-IL23R Competitive Binding ELISA

An Immulon® 4HBX plate was coated with 50 ng/well of IL23R_huFC and incubated overnight at 4° C. The wells were washed four times with PBST, blocked with PBS containing 3% Skim Milk for 1 hour at room temperature, and washed again four times with PBST. Serial dilutions of test peptides and IL-23 at a final concentration of 2 nM diluted in Assay Buffer (PBS containing 1% Skim Milk) were added to each well, and incubated for 2 hours at room temperature. After the wells were washed, bound IL-23 was detected by incubation with 50 ng/well of goat anti-p40 polyclonal antibodies (R&D Systems #AF309) diluted in Assay Buffer for 1 hour at room temperature. The wells were again washed four times with PBST. The secondary antibodies, HRP conjugated donkey anti-goat IgG (Jackson ImmunoResearch Laboratories #705-035-147) diluted 1:5000 in Assay Buffer was then added, and incubated for 30 minutes at room temperature. The plate was finally washed as above. Signals were visualized with TMB One Component HRP Membrane Substrate, quenched with 2 M sulfuric acid and read spectrophotometrically at 450 nm. IC50 values for various test peptides determined from these data are shown in Tables 3A-3H, 4A and 4B, 5A-5C, 6, 7, and 8.

Rat IL-23R Competitive Binding ELISA

An assay plate was coated with 300 ng/well of Rat IL-23R_huFC and incubated overnight at 4° C. The wells were washed, blocked, and washed again. Serial dilutions of test peptides and IL-23 at a final concentration of 7 nM were added to each well, and incubated for 2 hours at room temperature. After the wells were washed, bound IL-23 was detected with goat anti-p40 polyclonal antibodies, followed by an HRP conjugated donkey anti-goat IgG. Signals were visualized with TMB One Component HRP Membrane Substrate and quenched with 2 M sulfuric acid. IC50 values for various test peptides determined from these data are shown in Tables 3G, 3H, 4A, 4B, 5B, 5C and 8.

DB Cells IL23R pSTAT3 Cell Assay

IL-23 plays a central role in supporting and maintaining Th17 differentiation in vivo. This process is thought to mediated primarily through the Signal Transducer and Activator of Transcription 3 (STAT3), with phosphorylation of STAT3 (to yield pSTAT3) leading to upregulation of RORC and pro-inflammatory IL-17. This cell assay examines the levels of pSTAT3 in IL-23R-expressing DB cells when stimulated with IL-23 in the presence of test compounds. DB cells (ATCC #CRL-2289), cultured in RPMI-1640 medium (ATCC #30-2001) supplemented with 10% FBS and 1% Glutamine, were seeded at 5×10E5 cells/well in a 96 well tissue culture plate. Serial dilutions of test peptides and IL-23 at a final concentration of 0.5 nM were added to each well, and incubated for 30 minutes at 37° C. in a 5% $CO_2$ humidified incubator. Changes in phospho-STAT3 levels in the cell lysates were detected using the Cisbio HTRF pSTAT3 Cellular Assay Kit, according to manufacturer's Two Plate Assay protocol. IC50 values determined from these data are shown in Tables 3E, 3G, 3H, 4A, 4B, 5B, 5C, and 8 as absolute values or within ranges. Where not shown, data was not determined.

TABLE 3A

Illustrative Non-cyclic Peptides and Activities

| SEQ ID NO. | Sequence | ELISA IL23R/IL23 in nMoles (IC50) |
|---|---|---|
| 1 | Ac-[Aib]-[Aib]-TWQDYWLY-[Aib]-R-NH$_2$ | >100,000 |
| 2 | Ac-CAMTWQDYWLYGRC-NH$_2$ | 7200 |
| 3 | Ac-[Aib]-[Aib]-TWQDYWLYGR-NH$_2$ | >100,000 |
| 4 | Ac-AMTWQDYWLYGRK-NH$_2$ | 4100 |
| 5 | Ac-CAMTWQDYWLYGRCK-NH$_2$ | 8500 |
| 6 | Ac-KAMTWQDYWLYGR-NH$_2$ | 5600 |
| 7 | Ac-KCAMTWQDYWLYGRC-NH$_2$ | 10600 |
| 8 | Ac-AMTWAibDYWLYGR-NH$_2$ | >37,500 |
| 9 | Ac-AMTWQDYWLYGR-NH$_2$ | 6100 |
| 10 | Cyclo-[AMTWQDYWLYGR] | Not active |
| 11 | Hy-AATWQDYWLYGR-OH | 7785 |
| 12 | Hy-AMAWQDYWLYGR-OH | 24225 |
| 13 | Hy-AMTAQDYWLYGR-OH | N/A |
| 14 | Hy-AMTWADYWLYGR-OH | 6248 |
| 15 | Hy-AMTWQAYWLYGR-OH | 9589 |

TABLE 3B

Illustrative Peptides Containing the CXXXXC Motif with IC50 >1 uM in IL23-IL23R Competitive Binding ELISA

| SEQ ID NO. | Sequence |
|---|---|
| 87 | Hy-CSDWECYWHIFG-NH$_2$ |
| 88 | Hy-CETWECYWHSFS-NH$_2$ |
| 89 | Hy-CQSWECYWHYYG-NH$_2$ |
| 90 | Hy-CSDWRCYWHVFG-NH$_2$ |
| 91 | Hy-CHTWVCYWHEFS-NH$_2$ |
| 92 | Hy-CTDWVCYWHEYS-NH$_2$ |
| 93 | Hy-CQTWVCYWHTYG-NH$_2$ |
| 94 | Hy-CGNWECYWHVYG-NH$_2$ |
| 95 | Hy-CKDWKCYWHIYG-NH$_2$ |
| 96 | Hy-CRTWVCYWHVFG-NH$_2$ |
| 97 | Hy-CAD-[1-Nal]-VCYWHTFG-NH$_2$ |
| 98 | Hy-CAD-[2-Nal]-VCYWHTFG-NH$_2$ |
| 99 | Hy-CAD-[1-BIP]-VCYWHTFG-NH$_2$ |
| 100 | Hy-CAD-[Tic]-VCYWHTFG-NH$_2$ |
| 101 | Hy-CAD-[βhW]-VCYWHTFG-NH$_2$ |
| 102 | Hy-CADWVCY-[1-BIN]-HTFG-NH$_2$ |
| 103 | Hy-CADWVCY-[Tic]-HTFG-NH$_2$ |
| 104 | Hy-CADWVCY-[βhW]-HTFG-NH$_2$ |
| 105 | Hy-CADWVCYAHTFG-NH$_2$ |
| 106 | Hy-ACDWVCYWHTFG-NH$_2$ |
| 107 | Hy-ACDWCCYWCTFG-NH$_2$ |
| 108 | Hy-AADWCAYWCTFG-NH$_2$ |

TABLE 3B-continued

Illustrative Peptides Containing the CXXXXC Motif with IC50 >1 uM in IL23-IL23R Competitive Binding ELISA

| SEQ ID NO. | Sequence |
|---|---|
| 109 | Hy-CADWCCYWCTFG-$NH_2$ |
| 110 | Hy-CADWCCYWCTFG-$NH_2$ |
| 111 | Hy-CADWCCYWCTFG-$NH_2$ |
| 112 | Hy-CADWVCYWHTF-$NH_2$ |
| 113 | Hy-CADWVCYWHT-$NH_2$ |
| 114 | Hy-CADWVCYW-$NH_2$ |
| 115 | Hy-[β-Ala]-SCADWVCYWHTFG-OH |
| 116 | Ac-[(D)Lys]-SCADWVCYWHTFG-OH |
| 117 | Ac-[(D)Lys]-[β-Ala]-CADWVCYWHTFG-OH |
| 118 | Hy-[AEA]-CADWVCYWHTFG-OH |
| 119 | Ac-[(D)Lys]-CADWVCYWHTFG-OH |
| 120 | Ac-CKDWVCYWHTFG-OH |
| 121 | Ac-CADWKCYWHTFG-OH |
| 122 | Ac-CADWVCYWKTFG-OH |
| 123 | Ac-CADWVCYWHKFG-OH |
| 124 | Ac-CADWVCYWHTKG-OH |
| 125 | Ac-CADWVCYWHTF-[(D)Lys]-OH |
| 126 | Ac-CADWVCYWHTFG-$NH_2$ |
| 127 | Hy-CADWVCY-[1-Nal]-HTF-OH |
| 128 | Hy-CADWVCY-[1-Nal]-HT-[N-Me-Phe]-$NH_2$ |
| 129 | Hy-CADWVCY-[1-Nal]-H-[Sarc]-F-OH |
| 130 | Hy-CADWVCY-[1-Nal]-[N-Me-His]-TF-OH |
| 131 | Hy-CADWVCYWHTFGK-OH |
| 132 | Hy-C-[Sarc]-DWVCY-[1-Nal]-HTF-OH |
| 133 | Hy-CAD-[N-Me-Trp]-VCY-[1-Nal]-HTF-OH |
| 134 | Hy-CADW-[Sarc]-CY-[1-Nal]-HTF-OH |
| 135 | Hy-CADWVCY-[1-Nal]-HT-[(D)Phe]-OH |
| 136 | Hy-CADWVCY-[1-Nal]-HTF-[Sarc]-OH |
| 137 | Ac-CATWVCYWHTFG-$NH_2$ |
| 138 | Ac-CADWECYWHTFG-$NH_2$ |
| 139 | Ac-CADWVCYWHRCGWWGC-$NH_2$ |
| 140 | Ac-CADWVCY-[1-Nal]-H-[(D)Ala]-FG-$NH_2$ |
| 141 | Ac-CADWVCY-[1-Nal]-H-[Aib]-FG-$NH_2$ |
| 142 | Ac-CADWVCY-[1-Nal]-H-[b-Ala]-FG-$NH_2$ |
| 143 | Ac-CADWVCY-[1-Nal]-FTFG-$NH_2$ |
| 144 | Ac-CADWVCY-[1-Nal]-[(D)Ala]-TFG-$NH_2$ |
| 145 | Ac-CADWVCY-[1-Nal]-H-[Aib]-[(D)Phe]-G-$NH_2$ |

TABLE 3B-continued

Illustrative Peptides Containing the CXXXXC Motif with IC50 >1 uM in IL23-IL23R Competitive Binding ELISA

| SEQ ID NO. | Sequence |
|---|---|
| 146 | Ac-CADWVCY-[1-Nal]-HTF-[Aib]-NH$_2$ |
| 147 | Ac-CADWVCY-[1-Nal]-[N-Me-His]-[(D)Ala]-F-[Aib]-NH$_2$ |
| 148 | Ac-CADWVCY-[1-Nal]-H-[AEP]-G-NH$_2$ |
| 149 | Ac-CADWVCYW-[N-MeHis]-TFG-[AEA]-[(D)Lys]-NH$_2$ |
| 150 | Ac-CADWVCY-[Aic]-HTFG-[AEA]-[(D)Lys]-NH$_2$ |
| 151 | Ac-CADWVCY-[Bip]-HTFG-[AEA]-[(D)Lys]-NH$_2$ |
| 152 | Ac-CQTWQCYW-[N-MeArg]-ENG-[AEA]-[(D)-Lys]-NH$_2$ |
| 153 | Ac-CQTWQCYWR-[N-MeArg]-NG-[AEA]-[(D)-Lys]-NH$_2$ |
| 154 | Ac-CQTWQCYWR-[N-MeLys]-NG-[AEA]-[(D)-Lys]-NH$_2$ |
| 155 | Ac-CQTWQCYWR-[Sarc]-NG-[AEA]-[(D)-Lys]-NH$_2$ |
| 156 | Ac-CQTWQCYWR-[(D)Glu]-NG-[AEA]-[(D)-Lys]-NH$_2$ |
| 157 | Ac-CQTWQCYW-[(D)Arg]-ENG-[AEA]-[(D)-Lys]-NH$_2$ |
| 158 | Ac-CQTWQCYW-[(D)Arg]-[(D)Glu]-NG-[AEA]-[(D)Lys]-NH$_2$ |
| 159 | Ac-CQTWQCYW[N-MeGlu]-NG-[AEA]-[(D)-Lys] |
| 160 | Ac-CADWVC-NH$_2$ |
| 161 | Ac-CRDWQCYW-[N-MeArg]-KFG-[AEP]-[(D)-Lys]-NH$_2$ |
| 162 | Ac-CRDWQCYWR-[(D)Lys]-FG-[AEP]-[(D)-Lys]-NH$_2$ |
| 163 | Ac-CRDWQCYW-[(D)Arg]-KFG-[AEP]-[(D)-Lys]-NH$_2$ |
| 164 | Ac-CRDWQCYW-[(D)Arg]-[(D)Lys]-FG-[AEP]-[(D)-Lys]-NH$_2$ |
| 165 | Ac-CQTWQCYW-[N-MeArg]-ENG-[AEA]-[(D)-Lys]-NH$_2$ |

TABLE 3C

Illustrative Peptides Containing the CXXXXC Motif with IC50 of 500 nM to 1000 nM in IL23-IL23R Competitive Binding ELISA

| SEQ ID NO. | Sequence |
|---|---|
| 166 | Hy-CTDWKCYWHEFG-NH$_2$ |
| 167 | Hy-CRTWTCYWHVYG-NH$_2$ |
| 168 | Hy-CPNWECYWHRFG-NH$_2$ |
| 169 | Hy-CADWVCYWHTFG-NH$_2$ |
| 170 | Hy-CADWMCYWHEYG-NH$_2$ |
| 171 | Hy-CTTWKCYWHQYG-NH$_2$ |
| 172 | Hy-CSNWECYWHHYG-NH$_2$ |
| 173 | Hy-CSDWVCYWHVYG-NH$_2$ |
| 174 | Hy-CDTWKCYWHRQS-NH$_2$ |
| 175 | Hy-CADWVCY-[1-Nal]-HTFG-NH$_2$ |
| 176 | Hy-CADWVCY-[2-Nal]-HTFG-NH$_2$ |
| 177 | Hy-CADWVCYWHTFG-NH$_2$ |
| 178 | Ac-CADWVCYWHTFG-[(D)Lys]-OH |
| 179 | Ac-CADWVCYWHTFGAP-[(D)Lys]-OH |
|

TABLE 3C-continued

Illustrative Peptides Containing the CXXXXC Motif with IC50 of 500 nM to 1000 nM in IL23-IL23R Competitive Binding ELISA

| SEQ ID NO. | Sequence |
|---|---|
| 187 | Ac-[(D)Lys]-CRDWQCY-[1-Nal]-HTH-[Sarc]-[AEP]-[(D)Arg]-NH$_2$ |
| 188 | Ac-TQFDCRTWECYWHTFG-NH$_2$ |
| 189 | Ac-GGVECNDWQCYWHTFG-NH$_2$ |
| 190 | Ac-REGTCSTWKCYWHTFG-NH$_2$ |
| 191 | Ac-DTPRCRTWECYWHTFG-NH$_2$ |
| 192 | Ac-GGGECENWECYWHTFG-NH$_2$ |
| 193 | Ac-GDHKCSSWECYWHTFG-NH$_2$ |
| 194 | Ac-GSVHCMTWECYWHTFG-NH$_2$ |
| 195 | Ac-CADWVCY-[1-Nal]-VTFG-NH$_2$ |
| 196 | Ac-CADWVCYW-[(D)His]-TFG-[AEA]-[(D)Lys]-NH$_2$ |

TABLE 3D

Illustrative Peptides Containing the CXXXXC Motif with IC50 <500 nM in IL23-IL23R Competitive Binding ELISA

| SEQ ID NO. | Sequence |
|---|---|
| 197 | Hy-CRDWQCYWHKFG-NH$_2$ |
| 198 | Hy-CSNWVCYWHTYG-NH$_2$ |
| 199 | Ac-CADWVCYWHTFG-[β-Ala]-[(D)Lys]-OH |
| 200 | Ac-CADWVCYWHTFG-[AEA]-[(D)Lys]-OH |

TABLE 3E

IC50 of Illustrative Peptides Containing the CXXXXC Motif with Activities

| SEQ ID NO. | Sequence | ELISA IL23R/IL23 in nM | pStat3 HTRF in nMoles |
|---|---|---|---|
| 169 | Hy-CADWVCYWHTFG-NH$_2$ | **** | **** |
| 178 | Ac-CADWVCYWHTFG-[(D)Lys]-OH | **** | **** |
| 210 | Ac-CADWVCYWHTFGAP-[(D)Lys]-OH | **** | ND |
| 211 | Ac-CADWVCYWHTFGA[Azt]-[(D)Lys]-OH | **** | ND |
| 180 | Ac-CTDWKCYWHTFG-NH$_2$ | **** | **** |
| 196 | Ac-CADWVCYW-[(D)His]-TFG-[AEA]-[(D)Lys]-NH$_2$ | **** | **** |
| 281 | DIG dimererisation through N-termina Lysine (Ac-KMTWQDYWLYGR-NH$_2$)$_2$ | ***** | ***** |
| 284 | DIG dimererisation through C-terminal Lysine (Ac-AMTWQDYWLYGK-NH$_2$)$_2$ | ***** | ***** |

\* = <10 nM;
\*\* = 10-25 nM
\*\*\* = 25-100 nM,
\*\*\*\* = 100-1000 nM,
\*\*\*\*\* = 1000-10,000 nM.

TABLE 3F

IC50 of Illustrative Peptide Dimers

| SEQ ID NO. | Linker Moiety | Sequence | Human IL23R/IL23 ELISA (nM) |
|---|---|---|---|
| 277 | oxidized dimer through the cysteine | (Hy-FPTWEWYWCNRD-NH$_2$)$_2$ | ***** |
| 278 | oxidized dimer through the cysteine | (Hy-ALTWEFYWLCRE-NH$_2$)$_2$ | >10,000 |
| 291 | DIG through Lysine | (Hy-[βAla]SCADWVCYWHTFG-OH)$_2$DIG | >10,000 |
| 292 | DIG through Lysine | (Ac-[(D)Lys]-SCADWVCYWHTFG-OH)$_2$DIG | >10,000 |
| 293 | DIG through Lysine | (Ac-(D)Lys-[βAla]-CADWVCYWHTFG-OH)$_2$DIG | >10,000 |
| 294 | DIG through Lysine | (Hy-AEA-CADWVCYWHTFG-OH)$_2$DIG | >10,000 |
| 295 | DIG through Lysine | (Ac-[(D)Lys]-CADWVCYWHTFG-OH)$_2$DIG | >10,000 |
| 296 | DIG through Lysine | (Ac-CKDWVCYWHTFG-OH)$_2$DIG | >10,000 |
| 297 | DIG through Lysine | (Ac-CADWKCYWHTFG-OH)$_2$DIG | >10,000 |
| 298 | DIG through Lysine | (Ac-CADWVCYWKTFG-OH)$_2$DIG | |
| 299 | DIG through Lysine | (Ac-CADWVCYWHKFG-OH)$_2$DIG | >10,000 |
| 300 | DIG through Lysine | (Ac-CADWVCYWHTKG-OH)$_2$DIG | ***** |
| 301 | DIG through Lysine | (Ac-CADWVCYWHTFDK-OH)$_2$DIG | >10,000 |
| 302 | DIG through Lysine | (Ac-CADWVCYWHTFGDK)$_2$DIG | ***** |
| 303 | DIG through Lysine | (Ac-CADWVCYWHTFG-[β-Ala]-[(D)Lys]-OH)$_2$DIG | *** |

TABLE 3F-continued

IC50 of Illustrative Peptide Dimers

| SEQ ID NO. | Linker Moiety | Sequence | Human IL23R/IL23 ELISA (nM) |
|---|---|---|---|
| 304 | DIG through Lysine | (Ac-CADWVCYWHTFG-[AEA]-[(D)Lys]-OH)₂DIG | *** |
| 305 | DIG through C terminal Lysine | (Hy-CADWVCYWHTFGK-OH)₂DIG | ***** |
| 306 | PEG25 through Lysine | (Hy-[βAla]-SCADWVCYWHTFG-OH)₂PEG25 | |
| 307 | PEG25 through Lysine | (Ac-[(D)Lys]-SCADWVCYWHTFG-OH)₂ | |
| 308 | PEG25 through Lysine | (Ac-(D)Lys)-[βAla]-CADWVCYWHTFG-OH)₂ | |
| 309 | PEG25 through Lysine | (Hy-[AEA]-CADWVCYWHTFG-OH)₂ | |
| 310 | PEG25 through Lysine | (Ac-[(D)Lys]-CADWVCYWHTFG-OH)₂ | |
| 311 | PEG25 through Lysine | (Ac-CKDWVCYWHTFG-OH)₂ | |
| 312 | PEG25 through Lysine | (Ac-CADWKCYWHTFG-OH)₂ | |
| 313 | PEG25 through Lysine | (Ac-CADWVCYWKTFG-OH)₂ | |
| 314 | PEG25 through Lysine | (Ac-CADWVCYWHKFG-OH)₂ | |
| 315 | PEG25 through Lysine | (Ac-CADWVCYWHTKG-OH)₂ | |
| 316 | PEG25 through Lysine | (Ac-CADWVCYWHTF-[(D)Lys]-OH)₂ | |
| 317 | PEG25 through Lysine | (Ac-CADWVCYWHTFG-[(D)Lys]-OH)₂ | |
| 318 | PEG25 through Lysine | (Ac-CADWVCYWHTFG-[bAla]-[(D)Lys]-OH)₂ | |
| 319 | PEG25 through Lysine | (Ac-CADWVCYWHTFG-[AEA]-[(D)Lys]-OH)₂ | |
| 320 | PEG25 through C-terminal Lysine | (Hy-CADWVCYWHTFGK-OH)₂ | |

\* = <10 nM;
\*\* = 10-25 nM;
\*\*\* = 25-100 nM,
\*\*\*\* = 100-1000 nM,
\*\*\*\*\* = 1000-10,000 nM.

TABLE 3G

IC50 of Illustrative Peptides Containing the CXXWXCXXXXX-[(D)Lys] Motif

| SEQ ID NO. | Sequence | Human ELISA IL23/IL23R (nM) | Rat ELISA IL23/IL23R (nM) | pStat3 HTRF (nM) |
|---|---|---|---|---|
| 16 | Ac-CQDWQCYWR-[Cha]-FG-[AEA]-[(D)Lys]-NH₂ | 113 | | |
| 17 | Ac-CQTWQCYWR-[Ogl]-FG-[AEA]-[(D)Lys]-NH₂ | 206 | | |
| 18 | Ac-CQTWQCYWK-[Dap]-FG-[AEA]-[(D)Lys]-NH₂ | 32 | | |
| 19 | Ac-CQTWQCYWH-[Dap]-FG-[AEA]-[(D)Lys]-NH₂ | 49 | 59 | |
| 20 | Ac-CQTWQCYWRLFG-[AEA]-[(D)Lys]-NH₂ | 51 | 47 | |
| 21 | Ac-CQTWQCYW-[hArg]-[Dap]-FG-[AEA]-[(D)Lys]-NH₂ | 56 | | |
| 22 | Ac-CQTWQCYW-[Cit]-[Dap]-FG-[AEA]-[(D)Lys]-NH₂ | 25 | | |

TABLE 3G-continued

IC50 of Illustrative Peptides Containing the CXXWXCXXXXX-[(D)Lys] Motif

| SEQ ID NO. | Sequence | Human ELISA IL23/IL23R (nM) | Rat ELISA IL23/IL23R (nM) | pStat3 HTRF (nM) |
|---|---|---|---|---|
| 23 | Ac-CQTWQCYWRVFG-[AEA]-[(D)Lys]-NH$_2$ | 39 | 62 | 14 |
| 24 | Ac-CQTWQCYWR-[Dap]-[Tic]-G-[AEA]-[(D)Lys]-NH$_2$ | 892 | 65 | 12 |
| 25 | Ac-CQTWQCY-[Tic]-[Orn]-KFG-[AEA]-[(D)Lys]-NH$_2$ | >30000 | | |
| 26 | Ac-CQTWQCYR-[Dab]-FG-[AEA]-[(D)Lys]-NH$_2$ | 37 | | |
| 27 | Ac-CQTWQCYW-[Orn]-[Dap]-FG-[AEA]-[(D)Lys]-NH$_2$ | 79 | 276 | 37 |
| 28 | Ac-CQTWQCYWHENGA-[(D)Lys]-NH$_2$ | 220 | | |
| 29 | Ac-CRTWQCYWRENGA-[(D)Lys]-NH$_2$ | 102 | 86 | 17 |
| 30 | Ac-CRTWQCYWREYGA-[(D)Lys]-NH$_2$ | 78 | 80 | 8 |
| 31 | Ac-C-[N-MeAla]-DWVCYWHTFG-[AEA]-[(D)Lys]-NH$_2$ | 183 | | |
| 32 | Ac-CADWVCYWRKFG-[βAla]-[(D)Lys]-NH$_2$ | 57 | 33(1) | 13 |
| 33 | Ac-CADWVCYW-[Cit]-KFG-[β-Ala]-[(D)Lys]-NH$_2$ | 52 | | 29 |
| 34 | Ac-CADWVCYW-[Cit]-[Tle]-FG-[β-Ala]-[(D)Lys]-NH$_2$ | 518 | | |
| 35 | Ac-CADWVCYW-[Cit]-[Tba]-FG-[β-Ala]-[(D)Lys]-NH$_2$ | 153 | | |
| 36 | Ac-CADWVCYW-[Cit]-[Cha]-FG-[β-Ala]-[(D)Lys]-NH$_2$ | 223 | | |
| 37 | Ac-CADWVCY-[1-Nal]-[Cit]-VFG-[β-Ala]-[(D)Lys]-NH$_2$ | 79 | | 22 |
| 38 | Ac-CADWVCYW-[Cit]-VFG-[β-Ala]-[(D)Lys]-NH$_2$ | 124 | | |
| 39 | Ac-CADWVCYW-[Cit]-[Chg]-FG-[β-Ala]-[(D)Lys]-NH$_2$ | >30000 | | |
| 40 | Ac-CADWVCYW-[Cit]-[βAla]-FG-[β-Ala]-[(D)Lys]-NH$_2$ | 2584 | | |
| 41 | Ac-CADWVCYW-[Tle]-[Tle]-FG-[β-Ala]-[(D)Lys]-NH$_2$ | ~30000 | | |
| 42 | Ac-CADWVCYW-[Tle]-KFG-[β-Ala]-[(D)Lys]-NH$_2$ | 199 | | |
| 43 | Ac-CQTWQCYW-[(D)Ala]-VFG-[AEA]-[(D)Lys]-NH$_2$ | 232 | | |
| 44 | Ac-CQTWQCYW-[βAla]-VFG-[AEA]-[(D)Lys]-NH$_2$ | 2207 | | |
| 45 | Ac-CQTWQCYW-[(D)Leu]-VFG-[AEA]-[(D)Lys]-NH$_2$ | 188 | | |
| 46 | Ac-CQTWQCYW-[(D)Phe]-VFG-[AEA]-[(D)Lys]-NH$_2$ | 848 | | |
| 47 | Ac-CQTWQCYW-[(D)Asn]-VFG-[AEA]-[(D)Lys]-NH$_2$ | 61 | | |
| 48 | Ac-CQTWQCYW-[(D)Thr]-VFG-[AEA]-[(D)Lys]-NH$_2$ | 3662 | | |
| 49 | Ac-CQTWQCYW-[(D)Asp]-VFG-[AEA]-[(D)Lys]-NH$_2$ | 129 | | |
| 50 | Ac-CQTWQCYW-[Cit]-[(D)Leu]-FG-[AEA]-[(D)Lys]-NH$_2$ | 709 | | |
| 51 | Ac-CQTWQCYW-[Cit]-[(D)Phe]-FG-[AEA]-[(D)Lys]-NH$_2$ | 1304 | | |
| 52 | Ac-CQTWQCYW-[Cit]-[(D)Asn]-FG-[AEA]-[(D)Lys]-NH$_2$ | 269 | | |
| 53 | Ac-CQTWQCYW-[Cit]-[(D)Thr]-FG-[AEA]-[(D)Lys]-NH$_2$ | 1214 | | |
| 54 | Ac-CQTWQCYW-[Agp]-VNG-[AEA]-[(D)Lys]-NH$_2$ | 241 | | |
| 55 | Ac-CQTWQCY-[α-MeTrp]-RVNG-[AEA]-[(D)Lys]-NH$_2$ | ~6000 | | |
| 56 | Ac-CQTWQCY-[α-MeTrp]-[Cit]-[hLeu]-NG-[AEA]-[(D)Lys]-NH$_2$ | ~6000 | | |
| 57 | Ac-CQTWQCYW-[Cit]-VNG-[AEA]-[(D)Lys]-NH$_2$ | 73 | | |
| 58 | Ac-CQTWQCYW-[Agp]-[Dap]-NG-[AEA]-[(D)Lys]-NH$_2$ | 38 | | |

TABLE 3G-continued

IC50 of Illustrative Peptides Containing the CXXWXCXXXXX-[(D)Lys] Motif

| SEQ ID NO. | Sequence | Human ELISA IL23/IL23R (nM) | Rat ELISA IL23/IL23R (nM) | pStat3 HTRF (nM) |
|---|---|---|---|---|
| 59 | Ac-CQTWQCYW-[Cit]-VF-[(D)Ala]-[AEA]-[(D)Lys]-NH₂ | 397 | | |
| 60 | Ac-CQTWQCYW-[Cit]-VF-[(D)Leu]-[AEA]-[(D)Lys]-NH₂ | 444 | | |
| 61 | Ac-CQTWQCYW-[Cit]-VF-[(D)Phe]-[AEA]-[(D)Lys]-NH₂ | 784 | | |
| 62 | Ac-CQTWQCYW-[Cit]-VF-[(D)Asn]-[AEA]-[(D)Lys]-NH₂ | 93 | | |
| 63 | Ac-CQTWQCYW-[Cit]-VF-[(D)Thr]-[AEA]-[(D)Lys]-NH₂ | 518 | | |
| 64 | Ac-CQTWQCYW-[Cit]-VF-[(D)Asp]-[AEA]-[(D)Lys]-NH₂ | 551 | | |
| 65 | Ac-C-[N-MeArg]-TWQCYWRVFG-[AEA]-[(D)Lys]-NH₂ | 149 | 192 | 107 |
| 66 | Ac-C-[N-MeGln]-TWQCYWRVFG-[AEA]-[(D)Lys]-NH₂ | 69 | 85 | 101 |
| 67 | Ac-C-[Cit]-TWQCYWRVFG-[AEA]-[(D)Lys]-NH₂ | 50 | 76 | 107 |
| 68 | Ac-CADWVCYW-[Orn]-[Dap]-FG-[AEA]-[(D)Lys]-NH₂ | 382 | | |
| 69 | Ac-CADWVCY-[1-Nal]-[Orn]-[Dap]-FG-[AEA]-[(D)Lys]-NH₂ | 302 | | |
| 70 | Ac-CADWVCY-[(D)Trp]-[Orn]-[Dap]-FG-[AEA]-[(D)Lys]-NH₂ | >30000 | | |
| 71 | Ac-CADWVCY-[hPhe]-[Orn]-[Dap]-FG-[AEA]-[(D)Lys]-NH₂ | ~30000 | | |
| 72 | Ac-CADWVCY-[Bip]-[Orn]-[Dap]-FG-[AEA]-[(D)Lys]-NH₂ | >30000 | | |
| 73 | Ac-CADWVCY-[Phe(3,5-F₂)]-[Orn]-[Dap]-FG-[AEA]-[(D)Lys]-NH₂ | ~6000 | | |
| 74 | Ac-CADWVCY-[Phe(CONH₂)]-[Orn]-[Dap]-FG-[AEA]-[(D)Lys]-NH₂ | ~6000 | | |
| 75 | Ac-CADWVCY-[Phe(4-CF₃)]-[Orn]-[Dap]-FG-[AEA]-[(D)Lys]-NH₂ | >1000 | | |
| 76 | Ac-CADWVCY-[Phe(2,4-Me₂)]-[Orn]-[Dap]-FG-[AEA]-[(D)Lys]-NH₂ | 1525 | | |
| 77 | Ac-CMTWQCYWLYGR-[AEA]-[(D)Lys]-NH₂ | 398 | | |
| 77 | Hy-CMTWQCYWLYGR-[AEA]-[(D)Lys]-NH₂ | >30000 | | |
| 78 | Ac-CADWVCY-[βhTrp]-[Orn]-[Dap]-FG-[AEA]-[(D)Lys]-NH₂ | ~6000 | | |
| 79 | Ac-CADWVCYW-[Orn]-[α-MeLeu]-FG-[AEA]-[(D)Lys]-NH₂ | ~6000 | | |
| 80 | Ac-CADWVCYW-[Orn]-[β-spiral-pip]-FG-[AEA]-[(D)Lys]-NH₂ | 579 | | |
| 81 | Ac-CADWVCY-[4-Phenylcyclohexylalanine]-[Orn]-[Dap]-FG-[AEA]-[(D)Lys]-NH₂ | >3000 | | |
| 82 | Ac-CADWVCYW-[Orn]-[Aib]-FG-[AEA]-[(D)Lys]-NH₂ | 1085 | | |
| 83 | Ac-CADWVCYW-[Orn]-[DiethylGly]-FG-[AEA]-[(D)Lys]-NH₂ | ~6000 | | |
| 84 | Ac-CADWVCY-[α-MePhe(4-F)]-[Orn]-[Dap]-FG-[AEA]-[(D)Lys]-NH₂ | >30000 | | |
| 85 | Ac-CQTWQCY-[βhPhe]-RVNG-[AEA]-[(D)Lys]-NH₂ | >30000 | | |
| 86 | Ac-CQTWQCY-[β(1-Nal)]-RVNG-[AEA]-[(D)Lys]-NH2 | >30000 | | |

TABLE 3G-continued

IC50 of Illustrative Peptides Containing the CXXWXCXXXXX-[(D)Lys] Motif

| SEQ ID NO. | Sequence | Human ELISA IL23/IL23R (nM) | Rat ELISA IL23/IL23R (nM) | pStat3 HTRF (nM) |
|---|---|---|---|---|
| 321 | Ac-CQTWQCY-[βhTyr]-RVNG-[AEA]-[(D)Lys]-NH$_2$ | >30000 | | |
| 322 | Ac-CQTWQCY-[βhPhe(4-F)]-RVNG-[AEA]-[(D)Lys]-NH$_2$ | >30000 | | |
| 323 | Ac-CQTWQCY-[βNva(5-Phenyl)]-RVNG-[(D)Lys]-NH$_2$ | >30000 | | |
| 324 | Ac-CQTWQCY-[Phe(3,4-Cl$_2$)]-RVNG-[AEA]-[(D)Lys]-NH$_2$ | >30000 | | |
| 325 | Ac-CQTWQCY-[Tqa]-RVNG-[AEA]-[(D)Lys]-NH$_2$ | >30000 | | |
| 326 | Ac-CQTWQCYWR-[βhLeu]-NG-[AEA]-[(D)Lys]-NH$_2$ | 224 | | |
| 327 | Ac-CQTWQCYWR-[Aib]-NG-[AEA]-[(D)Lys]-NH$_2$ | 1065 | | |
| 328 | Ac-CQTWQCYWR-[βhAla]-NG-[AEA]-[(D)Lys]-NH$_2$ | 457 | | |
| 329 | Ac-CQTWQCYWR-[βhVal]-NG-[AEA]-[(D)Lys]-NH$_2$ | 328 | | |
| 330 | Ac-CQTWQCYWR-[β-spiral-pip]-NG-[AEA]-[(D)Lys]-NH$_2$ | 405 | | |
| 331 | Ac-CQTWQCYWR-[βGlu]-NG-[AEA]-[(D)Lys]-NH$_2$ | 250 | | |
| 332 | Ac-CQTWQCYW-[βhLeu]-VNG-[AEA]-[(D)Lys]-NH$_2$ | 311 | | |
| 333 | Ac-CQTWQCYW-[βAib]-VNG-[AEA]-[(D)Lys]-NH$_2$ | 2903 | | |
| 334 | Ac-CQTWQCYW-[βhAla]-VNG-[AEA]-[(D)Lys]-NH$_2$ | 355 | | |
| 335 | Ac-CQTWQCYW-[βhVal]-VNG-[AEA]-[(D)Lys]-NH$_2$ | 501 | | |
| 336 | Ac-CQTWQCYW-[β-spiral-pip]-VNG-[AEA]-[(D)Lys]-NH$_2$ | >6000 | | |
| 337 | Ac-CQTWQCYW-[βhArg]-VNG-[AEA]-[(D)Lys]-NH$_2$ | 922 | | |
| 338 | Ac-MRTWQ-[Me Cys]-YWRKFG-[AEA]-[(D)Lys]-NH$_2$ | 4251 | | |
| 339 | Ac-ACDWVCYWRKFG-[AEA]-[(D)Lys]-NH$_2$ | 630 | | |
| 340 | Ac-SRTWQSYWRKFG-[AEA]-[(D)Lys]-NH$_2$ | 2816 | | |
| 341 | Ac-CDWVCYWRKFG-[AEA]-[(D)Lys]-NH$_2$ | 664 | | |
| 342 | Ac-ARTWQ-[MeCys]-YWRKFG-[AEA]-[(D)Lys]-NH$_2$ | 7571 | | |
| 343 | Ac-ARTWQAYWRKFG-[AEA]-[(D)Lys]-NH$_2$ | 3194 | | |
| 344 | Ac-CQTWQCYW-[hLeu]-EN-[AEA]-[(D)Lys]-NH$_2$ | 132 | | |
| 345 | Ac-CQTWQCYW-[hLeu]-ENG-[AEA]-[(D)Lys]-NH$_2$ | 222 | | |
| 346 | Ac-CSTWECYWRVYG-[AEA]-[(D)Lys]-NH$_2$ | 47 | | |
| 347 | Ac-C-[Orn]-TWQCYWRVFG-[AEA]-[(D)Lys]-NH$_2$ | 22 | 69 | 95 |
| 348 | Ac-CQTWQCYW-[Orn]-[Dap]-FG-[AEA]-[(D)Lys]-NH$_2$ | 96 | | |
| 349 | Ac-C-[N-MeAsn]-TWQCYWRVFG-[AEA]-[(D)Lys]-NH$_2$ | 148 | | |
| 350 | Ac-C-[N-MeLys]-TWQCYWRVFG-[AEA]-[(D)Lys]-NH$_2$ | 80 | | |
| 351 | Ac-C-[Dab]-TWQCYWRVFG-[AEA]-[(D)Lys]-NH$_2$ | 23 | 51 | 99 |
| 352 | Ac-CQTWQCYY-[Orn]-[Dap]-FG-[AEA]-[(D)Lys]-NH$_2$ | 710 | | |
| 353 | Ac-C STWQCYW-[Orn]-[Dap]-YG-[AEA]-[(D)Lys]-NH$_2$ | 371 | | |
| 354 | Ac-CSTWECYW-[Cit]-[Dap]-YG-[AEA]-[(D)Lys]-NH$_2$ | 74 | | |

TABLE 3G-continued

IC50 of Illustrative Peptides Containing the CXXWXCXXXXX-[(D)Lys] Motif

| SEQ ID NO. | Sequence | Human ELISA IL23/IL23R (nM) | Rat ELISA IL23/IL23R (nM) | pStat3 HTRF (nM) |
|---|---|---|---|---|
| 355 | Ac-CQTWQCFF-[Orn]-[Dap]-FG-[AEA]-[(D)Lys]-NH$_2$ | 4274 | | |
| 356 | Ac-CPTWQCYWRVFG-[AEA]-[(D)Lys]-NH$_2$ | 422 | | |
| 357 | Ac-CSTWECYW-[Orn]-[Dab]-YG-[AEA]-[(D)Lys]-NH$_2$ | 338 | | |
| 358 | Ac-CSTWECYWRVFG-[AEA]-[(D)Lys]-NH$_2$ | 48 | | |
| 359 | Ac-CLTWQCYWRVFG-[AEA]-[(D)Lys]-NH$_2$ | 134 | | |
| 360 | Ac-CQTWQCYF-[Orn]-[Dap]-FG-[AEA]-[(D)Lys]-NH$_2$ | 1885 | | |
| 361 | Ac-CNTWQCYWRVFG-[AEA]-[(D)Lys]-NH$_2$ | 21 | 79 | 96 |
| 362 | Ac-C-[Dap]-TWQCYWRVFG-[AEA]-[(D)Lys]-NH$_2$ | 31 | | 100 |
| 363 | Ac-C-[N-Me-Ala]-TWQCYWRVFG-[AEA]-[(D)Lys]-NH$_2$ | 139 | | |
| 364 | Ac-CKTWQCYWRVFG-[AEA]-[(D)Lys]-NH$_2$ | 40 | | |
| 365 | Ac-CQDWQCYWR-[Cha]-FG-[AEA]-[(D)Lys]-NH$_2$ | 113 | | |
| 366 | Ac-CQTWQCYWR-[Ogl]-FG-[AEA]-[(D)Lys]-NH$_2$ | 206 | | |
| 367 | Ac-CQTWQCYWK-[Dap]-FG-[AEA]-[(D)Lys]-NH$_2$ | 32 | | |
| 368 | Ac-CQTWQCYWH-[Dap]-FG-[AEA]-[(D)Lys]-NH$_2$ | 49 | 59 | |
| 369 | Ac-CQTWQCYWRLFG-[AEA]-[(D)Lys]-NH$_2$ | 51 | 47 | |
| 370 | Ac-CQTWQCYW-[hArg]-[Dap]-FG-[AEA]-[(D)Lys]-NH$_2$ | 56 | | |

TABLE 3H

IC50 of Illustrative Peptides Containing the CXXWXCXXXX Motif

| SEQ ID NO | Sequence | Human IL23/IL23R ELISA (nM) | Rat IL23/IL23R ELISA (nM) | pStat3 HTRF (nM) |
|---|---|---|---|---|
| 371 | Ac-CSTWECYWRTFG-NH$_2$ | 252 | | |
| 372 | Ac-CDSWECYWRTYG-NH$_2$ | 366 | | |
| 373 | Ac-CSTWECYWHTYG-NH$_2$ | 181 | 286 | 97 |
| 374 | Ac-CKTWTCYWHTYG-NH$_2$ | 381 | | |
| 375 | Ac-CRTWECYWHEYS-NH$_2$ | 416 | | |
| 376 | Ac-CRTWTCYWHEYG-NH$_2$ | 434 | | |
| 377 | Ac-CFTWQCYWHEYS-NH$_2$ | 515 | | |
| 378 | Ac-CQTWQCYW-[3-Pal]-ENG-NH$_2$ | 56 | 20 | 101 |
| 379 | Ac-CQTWQC-NH$_2$ | >30000 | | |
| 380 | Ac-CRTWQC-NH$_2$ | >30000 | | |
| 381 | Ac-CADWVCY-NH$_2$ | >30000 | | |
| 382 | Ac-CADWVCYW-NH$_2$ | >30000 | | |
| 383 | Ac-CADWVCYH-NH$_2$ | ~30000 | | |

TABLE 3H-continued

IC50 of Illustrative Peptides Containing the CXXWXCXXXX Motif

| SEQ ID NO | Sequence | Human IL23/ IL23R ELISA (nM) | Rat IL23/ IL23R ELISA (nM) | pStat3 HTRF (nM) |
|---|---|---|---|---|
| 384 | Ac-CADWVCYWHT-NH2 | 4795 | | |
| 385 | Ac-CADWVCYWHTF-NH2 | 3277 | | |
| 386 | Ac-CMTWQCYWLYGR-NH2 | 613 | | |
| 387 | Ac-CRTWQCYWHEFG-NH2 | | | |
| 388 | Ac-CRTWECYWHTFG-NH2 | | | |
| 389 | Ac-CQTWQCYWHEFG-NH2 | | | |
| 390 | Ac-CRTWQCYWQQFGGE-NH2 | 81 | | |
| 391 | Ac-CRSWQCYWLNFGPD-NH2 | 101 | | |
| 392 | Ac-CRTWQCYWLKMGDS-NH2 | 39 | | |
| 393 | Ac-CQTWQCYWIKRDQG-NH2 | 67 | | |
| 394 | Ac-CSTWQCYWLKHGGE-NH2 | 19 | 24 | 2 |
| 395 | Ac-CSTWECYWSQRADQ-NH2 | 240 | | |
| 396 | Ac-CQTWECYWRTFGPS-NH2 | 58 | | |
| 397 | Ac-CRTWQCYWQEKGTD-NH2 | 118 | | |
| 398 | Ac-CQTWQCYWLDSLGD-NH2 | 93 | | |
| 399 | Ac-CRTWQCYWTKFGSEP-NH2 | 87 | | 57 |
| 1051 | Ac-CRSWQCYWNKFGADD-NH2 | 142 | | |
| 1052 | Ac-CHTWQCYWLNFGDEE-NH2 | 323 | | |
| 1053 | Ac-CRTWQCYWLNFGNEQ-NH2 | 127 | | |
| 1054 | Ac-CRTWQCYWSEFGTGE-NH2 | 180 | 778 | 103 |
| 1055 | Ac-CRTWQCYWLRLGDEG-NH2 | 352 | 483 | 181 |
| 1056 | Ac-CHTWQCYWSTLGPEA-NH2 | 222 | | |
| 1057 | Ac-CSTWQCYWSKQSGGS-NH2 | 133 | 204 | 89 |
| 1058 | Ac-CHTWQCYWLNNGTSQ-NH2 | 113 | | |
| 1059 | Ac-CHTWQCYWRANDGRD-NH2 | 210 | | |
| 1060 | Ac-SGCRTWQCYWHEFG-NH2 | 390 | | |
| 1061 | Ac-NKCRTWQCYWHEYG-NH2 | 112 | | |
| 1062 | Ac-SGCRTWECYWHEYG-NH2 | 257 | | |
| 1063 | Ac-DACRTWECYWHKFG-NH2 | 165 | | |
| 1064 | Ac-PECRTWECYWHKFG-NH2 | 197 | | |
| 1065 | Ac-QVCQTWECYWREFG-NH2 | 145 | | |
| 1066 | Ac-DRCVTWECYWREFG-NH2 | 217 | | |
| 1067 | Ac-ADQCRTWQCYWHEFG-NH2 | 228 | | |
| 1068 | Ac-KENCRTWECYWREFG-NH2 | 148 | | |
| 1069 | Ac-VQECSTWQCYWRTFG-NH2 | 138 | | |
| 1070 | Ac-GEECSTWQCYWRKFG-NH2 | 53 | | 24 |

TABLE 3H-continued

IC50 of Illustrative Peptides Containing the CXXWXCXXXX Motif

| SEQ ID NO | Sequence | Human IL23/ IL23R ELISA (nM) | Rat IL23/ IL23R ELISA (nM) | pStat3 HTRF (nM) |
|---|---|---|---|---|
| 1071 | Ac-DGSCRTWQCYWHQFG-NH$_2$ | 240 | | |
| 1072 | Ac-NADCHSWECYWREFG-NH$_2$ | 872 | | |
| 1073 | Ac-ERNCSTWECYWRAFG-NH$_2$ | 855 | | |
| 1074 | Ac-RVGCSTWECYWREFG-NH$_2$ | 417 | | |
| 1075 | Ac-KANCRTWQCYWRKFE-NH$_2$ | 412 | | |
| 1076 | Ac-YEDCRTWQCYWENFG-NH$_2$ | 280 | | |
| 1077 | Ac-CQTWQCYWRNFGDS-NH$_2$ | | | |
| 1078 | Ac-CQTWQCYWRNFESG-NH$_2$ | | | |
| 1079 | Ac-CQDWQCYWREFGPG-NH$_2$ | | | |
| 1080 | Ac-CQDWQCYWRSFGPQ-NH$_2$ | | | |
| 1081 | Ac-CQTWQCYWRTLGP S-NH$_2$ | | | |
| 1082 | Ac-CRTWQCYWQNFG-NH$_2$ | 235 | | |
| 1083 | Ac-CGTWQCYWRTFGP S-NH$_2$ | 76 | | |
| 1084 | Ac-CSTWQCYWHKFGNE-NH$_2$ | 182 | | |
| 1085 | Ac-CRTWECYWRTYGPS-NH$_2$ | 116 | | |
| 1086 | Ac-CRTWQCYWWENSQM-NH$_2$ | 99 | | |
| 1087 | Ac-CQTWQCYWREFGGG-NH$_2$ | 165 | | |
| 1088 | Ac-CQTWQCYWRTHGDR-NH$_2$ | 83 | | |
| 1089 | Ac-CRDWQCYWLSRP-NH$_2$ | 330 | | |
| 1090 | Ac-CQTWQCYW-[K(Palm)]-ENG-NH$_2$ | 4880 | | |
| 1091 | Ac-CQTWQCYW-[K(PEG8)]-ENG-NH$_2$ | 153 | | |
| 1092 | Ac-CQTWQCYW-[hLeu]-EQG-NH$_2$ | 128 | | |
| 1093 | Ac-CQTWQC-[(D)Tyr]-W-[hLeu]-ENG-NH$_2$ | >30000 | | |
| 1094 | Ac-CQTWQC-[(N-MeTyr)]-W-[hLeu]-ENG-NH$_2$ | >30000 | | |
| 1095 | Ac-CQTWQC-[Tic-OH]-W-[hLeu]-ENG-NH$_2$ | >30000 | | |
| 1096 | Ac-CQTWQCEW-[hLeu]-ENG-NH$_2$ | >30000 | | |
| 1097 | Ac-CQTWQCTW-[hLeu]-ENG-NH$_2$ | >30000 | | |
| 1098 | Ac-CQTWQC-[Cha]-W-[hLeu]-ENG-NH$_2$ | ~6000 | | |
| 1099 | Ac-CQTWQCYW-[α-MeLeu]-ENG-NH$_2$ | 22 | 27 | 5 |
| 1100 | Ac-CQTWQCYW-[(D)Leu]-ENG-NH$_2$ | 319 | | |
| 1101 | Ac-CQTWQCYW-[hLeu]-ENG-[(D)Lys]-NH$_2$ | 121 | | |
| 1102 | Ac-CQTWQCYW-[hLeu]-ENG-OH | 317 | | |
| 1103 | Ac-CQTWQCYW-[hLeu]-ENE-NH$_2$ | 222 | 1002 | 310 |
| 1104 | Ac-CQTWQCYW-[hLeu]-ENR-NH$_2$ | 93 | | |
| 1105 | Ac-CQTWQCYW-[hLeu]-ENF-NH$_2$ | 82 | 182 | 69 |
| 1106 | Ac-CQTWQCYW-[hLeu]-ENP-NH$_2$ | 253 | 114 | 31 |

TABLE 3H-continued

IC50 of Illustrative Peptides Containing the CXXWXCXXXX Motif

| SEQ ID NO | Sequence | Human IL23/IL23R ELISA (nM) | Rat IL23/IL23R ELISA (nM) | pStat3 HTRF (nM) |
|---|---|---|---|---|
| 1107 | Ac-CQTWQCYW-[hLeu]-ENQ-NH$_2$ | 347 | | |
| 1108 | Ac-CQTWQCYW-[hLeu]-ENL-NH$_2$ | 45 | | |
| 1109 | Ac-CQTWQCYW-[hLeu]-EEG-NH$_2$ | 135 | 53 | 16 |
| 1110 | Ac-CQTWQCYW-[hLeu]-ERG-NH$_2$ | 647 | | |
| 400 | Ac-CQTWQCYW-[hLeu]-EPG-NH$_2$ | 108 | 140 | 27 |
| 401 | Ac-CQTWQCYW-[hLeu]-ELG-NH$_2$ | 158 | | |
| 402 | Ac-CQTWQCYW-[hLeu]-ETG-NH$_2$ | 818 | | |
| 403 | Ac-CQTWQCYW-[hLeu]-FNG-NH$_2$ | 395 | | |
| 404 | Ac-CQTWQCYW-[hLeu]-PNG-NH$_2$ | 4828 | | |
| 405 | Ac-CQTWQCYW-[hLeu]-NNG-NH$_2$ | 89 | | 26 |
| 406 | Ac-CQTWQCYW-[hLeu]-LNG-NH$_2$ | 78 | | |
| 407 | Ac-CQTWQCYW-[hLeu]-TNG-NH$_2$ | 109 | | |
| 408 | Ac-CQTWQCYWFENG-NH$_2$ | 185 | | |
| 409 | Ac-CQTWQCYWPENG-NH$_2$ | >30000 | | |
| 410 | Ac-CQTWQCYWQENG-NH$_2$ | 173 | | |
| 411 | Ac-CQTWQCYWTENG-NH$_2$ | 114 | | |
| 412 | Ac-CQTWQCYWEENG-NH$_2$ | 147 | | |
| 413 | Ac-CQTWFCYW-[hLeu]-ENG-NH$_2$ | 1412 | | |
| 414 | Ac-CQTWPCYW-[hLeu]-ENG-NH$_2$ | 2735 | | |
| 415 | Ac-CQTWNCYW-[hLeu]-ENG-NH$_2$ | 1849 | | |
| 416 | Ac-CQTWRCYW-[hLeu]-ENG-NH$_2$ | 278 | | |
| 417 | Ac-CQTWTCYW-[hLeu]-ENG-NH$_2$ | 114 | | |
| 418 | Ac-CQTWECYW-[hLeu]-ENG-NH$_2$ | 164 | | |
| 419 | Ac-CQTGQCYW-[hLeu]-ENG-NH$_2$ | >10,000 | | |
| 420 | Ac-CQTPQCYW-[hLeu]-ENG-NH$_2$ | >10,000 | | |
| 421 | Ac-CQTNQCYW-[hLeu]-ENG-NH$_2$ | >10,000 | | |
| 422 | Ac-CQTRQCYW-[hLeu]-ENG-NH$_2$ | >10,000 | | |
| 423 | Ac-CQTTQCYW-[hLeu]-ENG-NH$_2$ | >10,000 | | |
| 424 | Ac-CQTEQCYW-[hLeu]-ENG-NH$_2$ | >10,000 | | |
| 425 | Ac-CQFWQCYW-[hLeu]-ENG-NH$_2$ | 1152 | | |
| 426 | Ac-CQPWQCYW-[hLeu]-ENG-NH$_2$ | >10,000 | | |
| 427 | Ac-CQNWQCYW-[hLeu]-ENG-NH$_2$ | 336 | | |
| 428 | Ac-CQRWQCYW-[hLeu]-ENG-NH$_2$ | 469 | | |
| 429 | Ac-CQEWQCYW-[hLeu]-ENG-NH$_2$ | 773 | | |
| 450 | Ac-CFTWQCYW-[hLeu]-ENG-NH$_2$ | 205 | | |
| 451 | Ac-CPTWQCYW-[hLeu]-ENG-NH$_2$ | 27412 | | |

TABLE 3H-continued

IC50 of Illustrative Peptides Containing the CXXWXCXXXX Motif

| SEQ ID NO | Sequence | Human IL23/ IL23R ELISA (nM) | Rat IL23/ IL23R ELISA (nM) | pStat3 HTRF (nM) |
|---|---|---|---|---|
| 452 | Ac-CNTWQCYW-[hLeu]-ENG-NH$_2$ | 61 | | |
| 453 | Ac-CGTWQCYW-[hLeu]-ENG-NH$_2$ | 167 | | |
| 454 | Ac-CTTWQCYW-[hLeu]-ENG-NH$_2$ | 59 | 28 | 10 |
| 455 | Ac-CETWQCYW-[hLeu]-ENG-NH$_2$ | 101 | | |
| 456 | Ac-CQTWQCYW-[N-MeLeu]-ENG-NH$_2$ | >6000 | | |
| 457 | Ac-CQTWQCYW-[α-MeOrn]-ENG-NH$_2$ | 46 | 64 | 12 |
| 458 | Ac-CQTWQCYW-[α-MeOrn]-ENG-NH$_2$ | 28 | 31 | 7 |
| 459 | Ac-CQTWQC-[α-MePhe]-W-[hLeu]-ENG-NH$_2$ | ~30000 | | |
| 460 | Ac-CQTWQCYW-[Aib]-ENG-NH$_2$ | 31 | 34 | 12 |
| 461 | Ac-CQTWQC-[hTyr]-W-[hLeu]-ENG-NH$_2$ | ~6000 | | |
| 462 | Ac-CQTWQC-[Bip]-W-[hLeu]-ENG-NH$_2$ | 237 | | |
| 463 | Ac-CQTWQCYW-[Ogl]-ENG-NH$_2$ | 66 | 163 | 76 |
| 464 | Ac-CQTWQCYW-[hLeu]-[Lys(Ac)]-NG-NH$_2$ | 19 | 32 | 3 |
| 465 | Ac-CQTWQCYW-[hLeu]-ENGG-NH$_2$ | 61 | 140 | 24 |
| 466 | Ac-CQTWQCYW-[hLeu]-ENGP-NH$_2$ | 97 | | |
| 467 | Ac-CQTWQCYW-[hLeu]-ENGE-NH$_2$ | 180 | | |
| 468 | Ac-CQTWQCYW-[hLeu]-ENG-(D)Glu-NH$_2$ | 183 | | |
| 469 | Ac-CQTWQCY-[α-MePhe]-[hLeu]-ENG-NH$_2$ | ~30000 | | |
| 470 | Ac-CQTWQCYW-[hLeu]-ENGP-NH$_2$ | 239 | | |
| 471 | Ac-CQTWQCYW-[hLeu]-ENGG-NH$_2$ | 362 | | |
| 472 | Ac-CQTWQCYW-[hLeu]-ENGL-NH$_2$ | 174 | | |
| 473 | Ac-CQTWQCYW-[hLeu]-ENGF-NH$_2$ | 131 | | |
| 474 | Ac-CQTWQCYW-[hLeu]-ENGE-NH$_2$ | 129 | | |
| 475 | Ac-CQTWQCYW-[hLeu]-ENGN-NH$_2$ | 66 | | 23 |
| 476 | Ac-CQTWQCYW-[hLeu]-ENGT-NH$_2$ | 160 | | |
| 477 | Ac-CQTWQCYW-[hLeu]-ENGR-NH$_2$ | >10,000 | | >1000 |
| 478 | Ac-PCQTWQCYW-[hLeu]-ENG-NH$_2$ | 97 | | |
| 479 | Ac-LCQTWQCYW-[hLeu]-ENG-NH$_2$ | 61 | 26 | 21 |
| 480 | Ac-FCQTWQCYW-[hLeu]-ENG-NH$_2$ | 56 | 25 | 16 |
| 481 | Ac-ECQTWQCYW-[hLeu]-ENG-NH$_2$ | | | |
| 482 | Ac-NCQTWQCYW-[hLeu]-ENG-NH$_2$ | | | |
| 483 | Ac-RCQTWQCYW-[hLeu]-ENG-NH$_2$ | | | |
| 484 | Ac-CQTWQCY-[2-Nal]-[hLeu]-ENG-NH$_2$ | | | |
| 485 | Ac-CQTWQCY-[1-Nal]-[hLeu]-ENG-NH$_2$ | 18 | 37 | 6 |
| 486 | Ac-CQTWQC-[2-Nal]-W-[hLeu]-ENG-NH2 | 48 | 73 | 11 |
| 487 | Ac-CQTWQC-[1-Nal]-[2-Nal]-[hLeu]-ENG-NH$_2$ | 78 | 125 | 17 |

TABLE 3H-continued

IC50 of Illustrative Peptides Containing the CXXWXCXXXX Motif

| SEQ ID NO | Sequence | Human IL23/IL23R ELISA (nM) | Rat IL23/IL23R ELISA (nM) | pStat3 HTRF (nM) |
|---|---|---|---|---|
| 488 | Ac-CQTWQC-[2-Nal]-[1-Nal]-[hLeu]-ENG-NH$_2$ | 117 | | |
| 489 | Ac-CQTWQC-[Aic]-W-[hLeu]-ENG-NH$_2$ | 126 | | |
| 490 | Ac-CQTWQCHW-[hLeu]-ENG-NH$_2$ | ~6000 | | |
| 491 | Ac-CQTWQCYH-[hLeu]-ENG-NH$_2$ | 398 | | |
| 492 | Ac-CQTWQC-[Tyr(OMe)]-W-[hLeu]-ENG-NH$_2$ | ~30000 | | |
| 493 | Ac-CQTWQCY-[Bip]-[hLeu]-ENG-NH$_2$ | 42 | 51 | 11 |
| 494 | Ac-CQTWQCY-[Tyr(OMe)]-[hLeu]-ENG-NH$_2$ | 998 | | |
| 495 | Ac-CQTWQCHH-[hLeu]-ENG-NH$_2$ | 148 | | |
| 496 | Ac-CQTWQCY-[α-MeTrp]-[hLeu]-EQG-NH$_2$ | >30000 | | |
| 497 | Ac-CQTW-[(K(PEG8)]-CYWLENG-NH$_2$ | 212 | | |
| 498 | Ac-CQTWQCYWX-LNG-NH$_2$ | 800 | | |
| 499 | Ac-CQTW-[K(PEG8)]CYW-[K(PEG8)]-ENG-NH$_2$ | 753 | | |
| 500 | Ac-CQTW-[K(Palm)]-CYWLENG-NH$_2$ | ~30000 | | |
| 501 | Ac-CQTWQCYW-[Orn]-[K(Palm)]-NG-NH$_2$ | >6000 | | |
| 502 | Ac-Gly-[(D)Asn]-(D)Glu-(D)Leu-(D)Trp-(D)Tyr-(D)Cys-(D)Gln-(D)Trp-(D)Thr-(D)Gln-(D)Cys-NH$_2$ | >30000 | | |
| 503 | Ac-CQTWQCYW-[(Orn)]-[K(Peg8)]-NG-NH$_2$ | 169 | | |
| 504 | Ac-CRTWQCYWHEFG-NH$_2$ | 166 | | |
| 505 | Ac-CRTWECYWHTFG-NH$_2$ | 333 | | |
| 506 | Ac-CQTWQCYWHEFG-NH$_2$ | 169 | | |
| 507 | Ac-CQTWQCYWRNFGDS-NH$_2$ | 96 | | |
| 508 | Ac-CQTWQCYWRNFESG-NH$_2$ | 315 | | |
| 509 | Ac-CQDWQCYWREFGPG-NH$_2$ | 82 | | |
| 510 | Ac-CQDWQCYWRSFGPQ-NH$_2$ | 117 | | |
| 511 | Ac-CQTWQCYWRTLGPSNH2 | 66 | | |
| 512 | Ac-CQTWQCYW-[(D)Pro]-ENG-NH$_2$ | >30000 | | |
| 513 | Ac-CQTWQCYWELNG-NH$_2$ | 79 | | |
| 514 | Ac-CQTWECYWELNG-NH$_2$ | 154 | | |
| 515 | Ac-CQTWQCY[(1-Nal)-[α-MeLeu]-ENG-NH$_2$ | 22 | 67 | 13 |
| 516 | Ac-CQTWQCY-[1-Nal]-[(D)Asn]-ENG-NH$_2$ | 145 | | 98 |
| 517 | Ac-CQTWQCYWLE-[K(Palm)]-G-NH$_2$ | >6000 | | |
| 518 | Ac-CQTWQCYWLEN-[K(Palm)]-NH$_2$ | 2800 | | |
| 519 | Ac-CSTWECYWRTFG-NH$_2$ | 252 | | |
| 520 | Ac-CDSWECYWRTYG-NH$_2$ | 366 | | |
| 521 | Ac-CSTWECYWHTYG-NH$_2$ | 181 | 286 | 97 |

TABLE 4A

IC50 of Illustrative examples of dimers of Peptides Containing
the Ac-[Pen]-XXWX-[Pen]-XXXX Motif and analogues

| SEQ ID NO. | Sequence | Human ELISA (nM) | Rat ELISA (nM) | pStat3 HTRF (nM) |
|---|---|---|---|---|
| 522 | [Ac-[Pen]-QTWQ-[Pen]-[Phe(4-OMe)]-[2-Nal]-[α-MeLys]-ENG-NH$_2$]$_2$ DIG | ** | | * |
| 523 | [Ac-[Pen]-QTWQ-[Pen]-[Phe(4-OMe)]-[2-Nal]-[α-MeLys]-ENG-NH$_2$]$_2$ PEG25 | * | | ** |
| 524 | [Ac-[Pen]-QTWQ-[Pen]-[Phe[4-(2-aminoethoxy)]-[2-Nal]-[α-Me-Leu]-QNN-NH$_2$]$_2$ DIG | ** | | ** |
| 525 | [Ac-[Pen]-QTWQ-[Pen]-[Phe[4-(2-aminoethoxy)]-[2-Nal]-[α-Me-Leu]-QNN-NH$_2$]$_2$ PEG25 | * | | ** |
| 526 | [Ac-[Pen]-QTWQ-[Pen]-[Phe[4-(2-aminoethoxy)]-[2-Nal]-[Aib]-[Lys(Ac)]-NQ-NH$_2$]$_2$ DIG | *** | | *** |
| 527 | [Ac-[Pen]-QTWQ-[Pen]-[Phe[4-(2-aminoethoxy)]-[2-Nal]-[Aib]-[Lys(Ac)]-NQ-NH2]$_2$ PEG25 | ** | | *** |
| 528 | [Ac-[Pen]-QTWQ-[Pen]-[Phe(4-OMe)]-[2-Nal]-[α-MeVal]-[Lys(Ac)]-NN-[D)Lys]]$_2$ DIG | | | * |
| 529 | [Ac-[Pen]-QTWQ[Pen]-[Phe[4-(2-acetylaminoethoxy)]-[2-Nal]-[α-MeVal]-[Lys(Ac)]-NN-[D)Lys]]$_2$ DIG | | | * |
| 530 | [Ac-[Pen]-QTWQ[Pen]-[Phe[4-(2-acetylaminoethoxy)]-[2-Nal]-[α-MeVal]-KNN-NH$_2$]$_2$ DIG | | ** | * |
| 531 | [Ac-[Pen]-QTWQ[Pen]-[Phe[4-(2-acetylaminoethoxy)]-[2-Nal]-K-[Lys(Ac)]-NN-NH$_2$]$_2$ DIG | | *** | * |
| 532 | [Ac-[Pen]-QTWQ-[Pen]-[Phe(4-OMe)]-[2-Nal]-[α-MeLys]-[Lys(Ac)]-NN-NH$_2$]$_2$ DIG | | ** | * |
| 533 | [Ac-[α-MeLys]-[Pen]-QTWQ-[Pen]-[Phe(4-CONH$_2$)]-[2-Nal]-[α-MeVal]-[Lys(Ac)]-NN-NH$_2$]$_2$ DIG | | | **** |
| 534 | [Ac-[Pen]-QTWQ-[Pen]-[Phe(4-CONH$_2$)]-[2-Nal]-[α-MeLys]-[Lys(Ac)]-NN-NH$_2$]$_2$ DIG | * | ** | * |
| 535 | [Ac-[Pen]-NTWQ-[Pen]-[Phe(4-CONH$_2$)]-[2-Nal]-[Aib]-KNN-NH$_2$]$_2$ DIG | * | ** | * |
| 536 | [Ac-[Pen]-NTWQ-[Pen]-[Phe(4-CONH$_2$)]-[2-Nal]-[4-amino-4-carboxy-tetrahydropyran]-KNN-NH$_2$]$_2$ DIG | | | * |
| 537 | [Ac-[Pen]-NTWQ-[Pen]-[Phe(4-CONH$_2$)]-[2-Nal]-[Achc]-KNN-NH$_2$]$_2$ DIG | | | * |
| 538 | [Ac-[Pen]-NTWQ-[Pen]-[Phe(4-CONH$_2$)]-[2-Nal]-[Acvc]-KNN-NH$_2$]$_2$ DIG | * | ** | * |
| 539 | [Ac-[Pen]-NTWQ-[Pen]-[Phe(4-CONH$_2$)]-[2-Nal]-[α-MeLeu]-KNN-NH$_2$]$_2$ DIG | | | * |
| 540 | [Ac-[Pen]-NTWQ-[Pen]-[Phe(4-OMe)]-[2-Nal]-[Aib]-KNN-NH$_2$]$_2$ DIG | | | * |
| 541 | [Ac-[Pen]-NTWQ-[Pen]-[Phe(4-OMe)]-[2-Nal]-[4-amino-4-carboxy-tetrahydropyran]-KNN-NH$_2$]$_2$ DIG | | | * |
| 542 | [Ac-[Pen]-NTWQ-[Pen]-[Phe(4-OMe)]-[2-Nal]-[Achc]-KNN-NH$_2$]$_2$ DIG | | | * |
| 543 | [Ac-[Pen]-NTWQ-[Pen]-[Phe(4-OMe)]-[2-Nal]-[Acvc]-KNN-NH$_2$]$_2$ DIG | | | * |
| 544 | [Ac-[Pen]-NTWQ-[Pen]-[Phe(4-OMe)]-[2-Nal]-[α-MeLeu]-KNN-NH$_2$]$_2$ DIG | | | * |
| 545 | [Ac-[Pen]-QTWQ-[Pen]-[Phe(4-CONH$_2$)]-[2-Nal]-[α-MeLys]-[Lys(Ac)]-NN-NH$_2$]$_2$ IDA | | | * |

TABLE 4A-continued

IC50 of Illustrative examples of dimers of Peptides Containing the Ac-[Pen]-XXWX-[Pen]-XXXX Motif and analogues

| SEQ ID NO. | Sequence | Human ELISA (nM) | Rat ELISA (nM) | pStat3 HTRF (nM) |
|---|---|---|---|---|
| 546 | [Ac-[Pen]-QTWQ-[Pen]-[Phe(4-CONH$_2$)]-[2-Nal]-[α-MeLys]-[Lys(Ac)]-NN-NH$_2$]$_2$ IDA-βAla] | | | * |

\* = <10 nM;
\*\* = 10-25 nM
\*\*\* = 25-100 nM,
\*\*\*\* = 100-1000 nM,
\*\*\*\*\* = 1000-10,000 nM.

TABLE 4B

IC50 of Illustrative Peptides Containing the Ac-[Pen]-XXWX-[Pen]-XXXX Motif and Analogues

| SEQ ID NO. | Sequence | Human ELISA (nM) | Rat ELISA (nM) | pStat3 HTRF (nM) |
|---|---|---|---|---|
| 547 | Ac-[Pen]-RTWQ-[Pen]-YWRKFG-[AEA]-[(D)-Lys]-NH$_2$ | **** | **** | *** |
| 548 | Ac-A-[Pen]-DWV-[Pen]-YWRKFG-[AEA]-[(D)-Lys]-NH$_2$ | >30000 | | |
| 549 | Ac-[[Pen]-QTWQ-[Pen]-YW-[hLeu]-ENG-NH$_2$ | **** | | |
| 550 | Ac-[Pen]-QTWQ-[Pen]-YW [N-MeArg]-ENG-NH$_2$ | >30000 | | |
| 551 | Ac-[Pen]-QTWQ-[Pen]-YW-[hLeu]-ENG-NH$_2$ | **** | | |
| 552 | Ac-[Pen]-QTWQ-[Pen]-YW[N-MeArg]-ENG-NH$_2$ | >30000 | | |
| 553 | Ac-A-[Pen]-DWV-[Pen]-YW-[Orn]-[Dap]-FG-[AEA]-[(D)-Lys]-NH$_2$ | >30000 | | |
| 554 | Ac-[Pen]-QTWQ-[Pen]-YW-[α-MeLeu]-ENG-NH$_2$ | *** | **** | ** |
| 555 | Ac-[Pen]-QTWQ-[Pen]-YW-[(D)Asn]-ENG-NH$_2$ | ***** | | |
| 556 | Ac-[Pen]-QTWQ-[Pen]-Y-[2-Nal]-[α-MeLys]-ENG-NH$_2$ | *** | **** | * |
| 557 | Ac-[Pen]-QTWQ-[Pen]-[Phe(4-OMe)]-[2-Nal]-[α-MeLys]-ENG-NH$_2$ | *** | **** | ** |
| 558 | Ac-[Pen]-QTWQ-[Pen]-[2-Nal]-[2-Nal]-[α-MeLys]-ENG-NH$_2$ | **** | **** | ** |
| 559 | Ac-[Pen]-QTWQ-[Pen]-Y-[2-Nal]-[α-MeOrn]-ENG-NH$_2$ | *** | **** | ** |
| 560 | Ac[Pen]-QTWQ-[Pen]-YW-[α-MeOrn]-ENG-NH$_2$ | **** | **** | *** |
| 561 | Ac-[Pen]-QTWQ-[Pen]-Y-[1-Nal]-[α-MeOrn]-ENG-NH$_2$ | **** | **** | *** |
| 562 | Ac-[Pen]-QTWQ-[Pen]-[Phe(4-OMe)]-[2-Nal]-[α-MeOrn]-[Lys(Ac)]-NG-NH$_2$ | **** | | *** |
| 563 | Ac-[Pen]-QTWQ-[Pen]-YW-[α-MeLys]-[Lys(Ac)]-NG-NH$_2$ | **** | | *** |
| 564 | Ac-[Pen]-QTWQ-[Pen]-[Phe-(4-OMe)]-W-[α-MeLys]-[Lys(Ac)]-NG-NH$_2$ | *** | *** | ** |
| 565 | Ac-[Pen]-QTWQ-[Pen]-[Phe(4-OMe)]-[2-Nal]-[α-MeLys]-[Lys(Ac)]-NG-NH$_2$ | *** | *** | * |
| 566 | Ac-[Pen]-QTWQ-[Pen]-[Phe(4-OMe)]-[1-Nal]-[α-MeLys]-[Lys(Ac)]-NG-NH$_2$ | *** | **** | *** |
| 567 | Ac-[Pen]-QTWQ-[Pen]-[BIP]-[2-Nal]-[α-MeLys]-[Lys(Ac)]-NG-NH$_2$ | >10,000 | | |
| 568 | Ac-[Pen]-QTWQ-[Pen]-Phe(3,4-Cl$_2$)-[2-Nal]-[α-MeLys]-[Lys(Ac)]-NG-NH$_2$ | **** | | |

TABLE 4B-continued

IC50 of Illustrative Peptides Containing the Ac-[Pen]-XXWX-[Pen]-XXXX Motif and Analogues

| SEQ ID NO. | Sequence | Human ELISA (nM) | Rat ELISA (nM) | pStat3 HTRF (nM) |
|---|---|---|---|---|
| 569 | Ac-[Pen]-QTWQ-[Pen]-[Phe(3,5-F$_2$)]-[2-Nal]-[α-MeLys]-[Lys(Ac)]-NG-NH$_2$ | **** | | |
| 570 | Ac-[Pen]-QTWQ-[Pen]-[Phe(4-NH$_2$)]-[2-Nal]-[α-MeLys]-[Lys(Ac)]-NG-NH$_2$ | **** | | |
| 571 | Ac-[Pen]-QTWQ-[Pen]-[2-Nal]-[α-MeLys]-[Lys(Ac)]-NG-NH$_2$ | >10000 | | |
| 572 | Ac-[Pen]-QTWQ[Pen]-[Phe(3,4-Cl$_2$)]-[2-Nal]-[α-MeOrn]-ENG-NH$_2$ | **** | | |
| 573 | Ac-[Pen]-QTWQ[Pen]-[Phe(4-CN)]-[2-Nal]-[α-MeOrn]-ENG-NH$_2$ | **** | | |
| 574 | Ac-[Pen]-QTWQ[Pen]-[Phe(3,5-F$_2$)]-[2-Nal]-[α-MeOrn]-ENG-NH$_2$ | **** | | |
| 575 | Ac-[Pen]-QTWQ[Pen]-[Phe(4-CH$_2$CO$_2$H)]-[2-Nal]-[α-MeOrn]-ENG-NH$_2$ | | | |
| 576 | Ac-[Pen]-QTWQ[Pen]-[Phe(4-CH$_2$COEt$_2$)]-[2-Nal]-[α-MeOrn]-ENG-NH$_2$ | | | |
| 577 | Ac-[Pen]-QTWQ[Pen]-[Phe(penta-F)]-[2-Nal]-[α-MeOrn]-ENG-NH$_2$ | | | |
| 578 | Ac-[Pen]-QTWQ[Pen]-[Phe(4-CF$_3$)]-[2-Nal]-[α-MeLys]-ENG-NH$_2$ | | | |
| 579 | Ac-[Pen]-QTWQ[Pen]-[Phe[4-(2-aminoethoxy)]-[2-Nal]-[α-MeLys]-ENG-NH$_2$ | | | |
| 580 | Ac-[Pen]-QTWQ[Pen]-[Phe[4-(2-aminoethoxy)]-[2-Nal]-[α-MeLys]-ENG-NH$_2$ | | | |
| 581 | Ac-[Pen]-QTWQ-[Pen]-[Phe(4-OMe)]-[2-Nal]-[α-MeLys]-K(ivDde)-NG-NH2 | **** | | |
| 582 | succinic acid-[Pen]-QTWQ[Pen]-[Phe(4-OMe)]-[2-Nal][α-MeLys]-[Lys(Ac)]-NG-NH$_2$ | *** | *** | * |
| 583 | glutaric acid-[Pen]-QTWQ[Pen]-[Phe(4-OMe)]-[2-Nal]-[α-MeLys]-[Lys(Ac)]-NG-NH$_2$ | *** | *** | ** |
| 584 | 4-methylmorpholine-2,6-dione-[Pen]-QTWQ[Pen]-[Phe(4-OMe)]-[2-Nal]-[α-MeLys]-[Lys(Ac)]-NG-NH$_2$ | *** | *** | ** |
| 585 | pyroglutamic acid-[Pen]-QTWQ[Pen]-[Phe(4-OMe)]-[2-Nal]-[α-MeLys]-[Lys(Ac)]-NG-NH$_2$ | *** | *** | * |
| 586 | isovaleric acid-[Pen]-QTWQ[Pen]-[Phe(4-OMe)]-[2-Nal]-[α-MeLys]-[Lys(Ac)]-NG-NH$_2$ | *** | *** | ** |
| 587 | gallic acid-[Pen]-QTWQ[Pen]-[Phe(4-OMe)]-[2-Nal]-[α-MeLys]-[Lys(Ac)]-NG-NH$_2$ | ***** | | |
| 588 | octanoic acid-[Pen]-QTWQ[Pen]-[Phe(4-OMe)]-[2-Nal]-[α-MeLys]--[Lys(Ac)]-NG-NH$_2$ | **** | | |
| 589 | 4-Biphenylacetic acid-[Pen]-QTWQ[Pen]-[Phe(4-OMe)]-[2-Nal]--[α-MeLys]-[Lys(Ac)]-NG-NH$_2$ | **** | | |
| 590 | 4-fluorophenylacetic acid-[Pen]-QTWQ-[Pen]-[Phe(4-OMe)]-[2-Nal]-[α-MeLys]-[Lys(Ac)]-NG-NH$_2$ | *** | **** | * |
| 591 | Hy-[Pen]-ADWV-[Pen]-YWHTFG-NH$_2$ | >6000 | | |
| 592 | Ac-[Pen]-GTWQ-[Pen]-[Phe[4-(2-aminoethoxy)]-[2-Nal]-[α-MeLys]-ENG-NH$_2$ | ** | | * |
| 593 | Ac-[Pen]-TTWQ-[Pen]-[Phe[4-(2-aminoethoxy)]-[2-Nal]-[α-MeLys]-ENG-NH$_2$ | ** | | * |

TABLE 4B-continued

IC50 of Illustrative Peptides Containing the Ac-[Pen]-XXWX-[Pen]-XXXX Motif and Analogues

| SEQ ID NO. | Sequence | Human ELISA (nM) | Rat ELISA (nM) | pStat3 HTRF (nM) |
|---|---|---|---|---|
| 594 | Ac-[Pen]-STWQ-[Pen]-[Phe[4-(2-aminoethoxy)]-[2-Nal]-[α-MeLys]-ENG-NH₂ | ** | | * |
| 595 | Ac-[Pen]-[Dap]-TWQ-[Pen]-[Phe[4-(2-aminoethoxy)]-[2-Nal]-[α-MeLys]-ENG-NH₂ | * | *** | * |
| 596 | Ac-[Pen]-[α-MeOrn]-TWQ[Pen]-[Phe[4-(2-aminoethoxy)]-[2-Nal]-[α-MeLys]-ENG-NH₂ | **** | | |
| 597 | Ac-[Pen]-NTWQ-[Pen]-[Phe[4-(2-aminoethoxy)]-[2-Nal]-[α-MeLys]-ENG-NH2 | * | | * |
| 598 | Ac-[Pen]-QTWQ-[Pen]-[Phe[4-(2-aminoethoxy)]-[2-Nal]-[α-MeLys]-[Lys(Ac)]-NG-NH₂ | * | *** | * |
| 599 | Ac-[Pen]-QTWQ-[Pen]-[Phe[4-(2-aminoethoxy)]-[2-Nal]-[α-MeLys]-[Lys(Ac)]-NN-NH₂ | * | ** | * |
| 600 | Ac-[Pen]-QTWQ-[Pen]-[Phe[4-(2-aminoethoxy)]-[2-Nal]-[α-MeLys]-ENG-NH₂ | ** | | * |
| 601 | Ac-[Pen]-QTWQ-[Pen]-[Phe[4-(2-aminoethoxy)]-[2-Nal]-[α-MeLys]-ENA-NH₂ | * | *** | * |
| 602 | Ac-[Pen]-QTWQ-[Pen]-[Phe[4-(2-aminoethoxy)]-[2-Nal]-[α-MeLeu]-[Lys(Ac)]-NN-NH₂ | * | * | * |
| 603 | Ac-[Pen]-QTWQ-[Pen]-[Phe[4-(2-aminoethoxy)]-[2-Nal]-[α-MeLeu]-QNN-NH₂ | * | * | * |
| 604 | Ac-[Pen]-QTWQ-[Pen]-[Phe[4-(2-aminoethoxy)]-[2-Nal]-[Aib]-ENN-NH₂ | * | | * |
| 605 | Ac-[Pen]-QTWQ-[Pen]-[Phe[4-(2-aminoethoxy)]-[2-Nal]-Aib-[Lys(Ac)]-NN-NH₂ | * | | * |
| 606 | Ac-[Pen]-QTWQ-[Pen]-[Phe[4-(2-aminoethoxy)]-[2-Nal]-[Aib]-[Lys(Ac)]-NQ-NH₂ | * | | * |
| 607 | Ac-[Pen]-Dap(Ac)TWQ-[Pen]-[Phe[4-(2-acetylaminoethoxy)]-[2-Nal]-[α-MeLys(Ac)]-ENG-NH₂ | ** | | * |
| 608 | Ac-[Pen]-[α-MeOrn(Ac)]-TWQ-[Pen]-[Phe[4-(2-acetylaminoethoxy)]-[2-Nal]-[α-MeLys(Ac)]-ENG-NH₂ | **** | | |
| 609 | Ac-[Pen]-QTWQ-[Pen]-[Phe[4-(2-acetylaminoethoxy)]-[2-Nal]-[α-MeLys(Ac)]-[Lys(Ac)]-NG-NH₂ | * | | * |
| 610 | Ac-[Pen]-QTWQ-[Pen]-[Phe[4-(2-acetylaminoethoxy)]-[2-Nal]-[α-MeLys(Ac)]-[Lys(Ac)]-NN-NH₂ | * | | * |
| 611 | Ac-[Pen]-QTWQ-[Pen]-[Phe[4-(2-acetylaminoethoxy)]-[2-Nal]-[α-MeLys(Ac)]-ENG-NH₂ | ** | | * |
| 612 | Ac-[Pen]-QTWQ-[Pen]-[Phe[4-(2-acetylaminoethoxy)]-[2-Nal]-[α-MeLys(Ac)]-ENA-NH₂ | ** | | * |
| 613 | Ac-[Pen]-QTWQ-[Pen]-[Phe[4-(2-acetylaminoethoxy)]-[2-Nal]-[α-MeLeu]-[Lys(Ac)]-NN-NH₂ | * | | * |
| 614 | Ac-[Pen]-QTWQ-[Pen]-[Phe[4-(2-acetylaminoethoxy)]-[2-Nal]-[α-MeLeu]-QNN-NH₂ | * | | * |
| 615 | Ac-[Pen]-QTWQ-[Pen]-[Phe[4-(2-acetylaminoethoxy)]-[2-Nal]-[Aib]-ENN-NH₂ | ** | | * |
| 616 | Ac-[Pen]-QTWQ-[Pen]-[Phe[4-(2-acetylaminoethoxy)]-[2-Nal]-[Aib]-[Lys(Ac)]-NN-NH₂ | * | | * |
| 617 | Ac-[Pen]-QTWQ-[Pen]-[Phe[4-(2-acetylaminoethoxy)]-[2-Nal]-[Aib]-[Lys(Ac)]-NQ-NH₂ | * | | * |
| 618 | Ac-[Pen]-QTWQ-[Pen]-[Phe(4-OMe)]-[2-Nal]-[Aib]-ENN-NH₂ | | | * |

TABLE 4B-continued

IC50 of Illustrative Peptides Containing the Ac-[Pen]-XXWX-[Pen]-XXXX Motif and Analogues

| SEQ ID NO. | Sequence | Human ELISA (nM) | Rat ELISA (nM) | pStat3 HTRF (nM) |
|---|---|---|---|---|
| 619 | Ac-[Pen]-QTWQ-[Pen]-[Phe[4-(2-aminoethoxy)]-[2-Nal]-[hLeu]-ENA-NH$_2$ | | | ** |
| 620 | Ac-[Pen]-TTWQ-[Pen]-[Phe[4-(2-aminoethoxy)]-[2-Nal]-[Aib]-[Lys(Ac)]-NN-NH$_2$ | | | * |
| 621 | Ac-[Pen]-QTWQ-[Pen]-[Phe(4-OMe)]-[2-Nal]-[Aib]-[Lys(Ac)]-NA-NH$_2$ | | | * |
| 622 | Ac-[Pen]-TTWQ-[Pen]-[Phe[4-(2-aminoethoxy)]-[2-Nal]-[Aib]-[Lys(Ac)]-NQ-NH$_2$ | | | * |
| 623 | Ac-[Pen]-QTWQ-[Pen]-[Phe(4-OMe)]-[2-Nal]-[Aib]-[Lys(Ac)]-NQ-NH$_2$ | | | * |
| 624 | Ac-[Pen]-QTWQ-[Pen]-[Phe[4-(2-aminoethoxy)]-[2-Nal]-[Aib]-[Lys(Ac)]-NA-NH$_2$ | | | * |
| 625 | Ac-[Pen]-QTWQ-[Pen]-[Phe(4-OMe)]-[2-Nal]-[Aib]-[Lys(Ac)]-NN-NH$_2$ | | | * |
| 626 | Ac-[Pen]-QTWQ-[Pen]-[Phe[4-(2-aminoethoxy)]-[2-Nal]-[hLeu]-[Lys(Ac)]-N-[βAla]-NH$_2$ | | | * |
| 627 | Ac-[Pen]-QTWQ-[Pen]-[Phe(4-OMe)]-[2-Nal]-[hLeu]-[Lys(Ac)]-N-[βAla]-NH$_2$ | | | * |
| 628 | Ac-[Pen]-QTWQ-[Pen]-[Phe[4-(2-aminoethoxy)]-[2-Nal]-[Aib]-[Lys(Ac)]-N-[βAla]-NH$_2$ | | | * |
| 629 | Ac-[Pen]-QTWQ-[Pen]-[Phe(4-OMe)]-[2-Nal]-[Aib]-[Lys(Ac)]-N-βAla]-NH$_2$ | | | * |
| 630 | Ac-[Pen]-NTWQ-[Pen]-[Phe(4-OMe)]-[2-Nal]-[Aib]-ENN-NH$_2$ | | | * |
| 631 | Ac-[Pen]-NTWQ-[Pen]-[Phe[4-(2-aminoethoxy)]-[2-Nal]-[hLeu]-ENA-NH$_2$ | | | * |
| 632 | Ac-[Pen]-NTWQ-[Pen]-[Phe[4-(2-aminoethoxy)]-[2-Nal]-[Aib]-[Lys(Ac)]-NN-NH$_2$ | * | * | * |
| 633 | Ac-[Pen]-NTWQ-[Pen]-[Phe(4-OMe)]-[2-Nal]-[Aib]-[Lys(Ac)]-N-[βAla]-NH$_2$ | | | * |
| 634 | Ac-[Pen]-NTWQ-[Pen]-[Phe[4-(2-aminoethoxy)]-[2-Nal]-[Aib]-[Lys(Ac)]-NQ-NH$_2$ | | | * |
| 635 | Ac-[Pen]-NTWQ-[Pen]-[Phe(4-OMe)]-[2-Nal]-[Aib]-[Lys(Ac)]-NA-NH$_2$ | | | * |
| 636 | Ac-[Pen]-NTWQ-[Pen]-[Phe[4-(2-aminoethoxy)]-[2-Nal]-[Aib]-[Lys(Ac)]-NA-NH$_2$ | | | * |
| 637 | Ac-[Pen]-NTWQ-[Pen]-[Phe(4-OMe)]-[2-Nal]-[Aib]-[Lys(Ac)]-NN-NH$_2$ | | | * |
| 638 | Ac-[Pen]-NTWQ-[Pen]-[Phe(4-OMe)]-[2-Nal]-[Aib]-[Lys(Ac)]-NQ-NH$_2$ | | | * |
| 639 | Ac-[Pen]-NTWQ-[Pen]-[Phe[4-(2-aminoethoxy)]-[2-Nal]-[Aib]-[Lys(Ac)]-N-[βAla]-NH$_2$ | | ** | * |
| 640 | Ac-[Pen]-NTWQ-[Pen]-[Phe(4-OMe)]-[2-Nal]-[hLeu]-[Lys(Ac)]-N-[βAla]-NH$_2$ | | | * |
| 641 | Ac-[Pen]-NTWQ-[Pen]-[Phe[4-(2-aminoethoxy)]-[2-Nal]-[hLeu]-[Lys(Ac)]-N-[βAla]-NH2 | | | * |
| 642 | Ac-E-[Pen]-QTWQ-[Pen]-[Phe[4-(2-aminoethoxy)]-[2-Nal]-[Aib]-[Lys(Ac)]-NN-NH$_2$ | | | * |

TABLE 4B-continued

IC50 of Illustrative Peptides Containing the Ac-[Pen]-XXWX-[Pen]-XXXX Motif and Analogues

| SEQ ID NO. | Sequence | Human ELISA (nM) | Rat ELISA (nM) | pStat3 HTRF (nM) |
|---|---|---|---|---|
| 643 | Ac-(D)Asp-[Pen]-QTWQ-[Pen]-[Phe[4-(2-aminoethoxy)]-[2-Nal]-[Aib]-[Lys(Ac)]-NN-NH$_2$ | | | * |
| 644 | Ac-R-[Pen]-QTWQ-[Pen]-[Phe[4-(2-aminoethoxy)]-[2-Nal]-[Aib]-[Lys(Ac)]-NN-NH$_2$ | | | * |
| 645 | Ac-(D)Arg-[Pen]-QTWQ-[Pen]-[Phe[4-(2-aminoethoxy)]-[2-Nal]-[Aib]-[Lys(Ac)]-NN-NH$_2$ | | | * |
| 646 | Ac-Phe-[Pen]-QTWQ-[Pen]-[Phe[4-(2-aminoethoxy)]-[2-Nal]-[Aib]-[Lys(Ac)]-NN-NH$_2$ | | | * |
| 647 | Ac-(D)Phe-[Pen]-QTWQ-[Pen]-[Phe[4-(2-aminoethoxy)]-[2-Nal]-[Aib]-[Lys(Ac)]-NN-NH$_2$ | | | * |
| 648 | Ac-[2-Nal]-[Pen]-QTWQ-[Pen]-[Phe[4-(2-aminoethoxy)]-[2-Nal]-[Aib]-[Lys(Ac)]-NN-NH$_2$ | | | * |
| 649 | Ac-T-[Pen]-QTWQ-[Pen]-[Phe[4-(2-aminoethoxy)]-[2-Nal]-[Aib]-[Lys(Ac)]-NN-NH$_2$ | | | * |
| 650 | Ac-L-[Pen]-QTWQ-[Pen]-[Phe[4-(2-aminoethoxy)]-[2-Nal]-[Aib]-[Lys(Ac)]-NN-NH$_2$ | | | * |
| 651 | Ac-(D)Gln-[Pen]-QTWQ-[Pen]-[Phe[4-(2-aminoethoxy)]-[2-Nal]-[Aib]-[Lys(Ac)]-NN-NH$_2$ | | | |
| 652 | Ac-[(D)Asn]-[Pen]-QTWQ-[Pen]-[Phe[4-(2-aminoethoxy)]-[2-Nal]-[Aib]-[Lys(Ac)]-NN-NH$_2$ | | | |
| 653 | Ac-[Pen]-QTWQ-[Pen]-[Phe(4-OMe)]-[2-Nal]-[α-MeVal]-[Lys(Ac)]-NN-[(D)Lys]-NH$_2$ | | | * |
| 654 | Ac-[Pen]-QTWQ-[Pen]-[Phe[4-(2-acetylaminoethoxy)]-[2-Nal]-[α-MeVal]-KNN-NH$_2$ | | | * |
| 655 | Ac-[Pen]-QTWQ-[Pen]-[Phe[4-(2-acetylaminoethoxy)]-[2-Nal]-K-[Lys(Ac)]-NN-NH$_2$ | | | *** |
| 666 | Ac-[Pen]-QTWQ-[Pen]-[Phe(4-OMe)]-[2-Nal]-[α-MeLys]-[Lys(Ac)]-NN-NH$_2$ | | | * |
| 667 | Ac-[(D)Lys]-[Pen]-QTWQ-[Pen]-[Phe(4-CONH$_2$)]-[2-Nal]-[α-MeVal]-[Lys(Ac)]-NN-NH$_2$ | | | ***** |
| 668 | Ac-[Pen]-QTWQ-[Pen]-[Phe(4-CONH$_2$)]-[2-Nal]-[α-MeLys]-[Lys(Ac)]-NN-NH$_2$ | *** | | * |
| 669 | Ac-[Pen]-QTWQ-[Pen]-[Phe(4-CONH$_2$)]-[2-Nal]-[α-MeVal]-[Lys(Ac)]-NN-NH$_2$ | ** | | * |
| 670 | Ac-[Pen]-QTWQ[Pen]-[Phe(4-CONH$_2$)]-[Phe(3,4-OMe$_2$)[α-MeVal]-[Lys(Ac)]-NN-NH$_2$ | | | ** |
| 671 | Ac-[(D)Phe]-[Pen]-NTWQ[Pen]-[Phe[4-(2-aminoethoxy)]-[2-Nal]-[Aib]-[Lys(Ac)]-NN-NH$_2$ | | | |
| 672 | Ac-[(D)Phe]-[Pen]-NTWQ-[Pen]-[Phe[4-(2-aminoethoxy)]-[2-Nal]-[4-amino-4-carboxy-tetrahydropyran]-[Lys(Ac)]-NN-NH$_2$ | | | |
| 673 | Ac-[(D)Phe]-[Pen]-NTWQ[Pen]-[Phe[4-(2-aminoethoxy)]-[2-Nal]-[Achc]-[Lys(Ac)]-NN-NH$_2$ | | | |
| 674 | Ac-[(D)Phe]-[Pen]-NTWQ-[Pen]-[Phe[4-(2-aminoethoxy)]-[2-Nal]-[4-amino-4-carboxy-tetrahydropyran]-[Cit]-NN-NH$_2$ | | | |
| 675 | Ac-[(D)Phe]-[Pen]-NTWQ-[Pen]-[Phe[4-(2-aminoethoxy)]-[2-Nal]-[Achc]-[Cit]-NN-NH$_2$ | | | |
| 676 | Ac-[(D)Phe]-[Pen]-NTWQ-[Pen]-[Phe[4-(2-aminoethoxy)]-[2-Nal]-[Aib]-[Lys(Ac)]-N-[βAla]-NH$_2$ | | | |

TABLE 4B-continued

IC50 of Illustrative Peptides Containing the Ac-[Pen]-XXWX-[Pen]-XXXX Motif and Analogues

| SEQ ID NO. | Sequence | Human ELISA (nM) | Rat ELISA (nM) | pStat3 HTRF (nM) |
|---|---|---|---|---|
| 677 | Ac-[(D)Phe]-[Pen]-NTWQ-[Pen]-[Phe(4-OMe)]-[2-Nal]-[4-amino-4-carboxy-tetrahydropyran]-[Lys(Ac)]-NN-NH$_2$ | | | |
| 678 | Ac-[(D)Phe]-[Pen]-NTWQ-[Pen]-[Phe(4-OMe)]-[2-Nal]-[Achc]-[Lys(Ac)]-NN-NH$_2$ | | | |
| 679 | Ac-[(D)Phe]-[Pen]-NTWQ-[Pen]-[Phe(4-OMe)]-[2-Nal]-[4-amino-4-carboxy-tetrahydropyran]-[Cit]-NN-NH$_2$ | | | |
| 680 | Ac-[(D)Phe]-[Pen]-NTWQ-[Pen]-[Phe(4-OMe)]-[2-Nal]-[Achc]-[Cit]-NN-NH$_2$ | | | |
| 681 | Ac-[(D)Phe]-[Pen]-NTWQ-[Pen]-[Phe(4-OMe)]-[2-Nal]-[Achc]-ENN-NH$_2$ | | | |
| 682 | Ac-[Pen]-NTWQ[Pen]-[Phe(4-CONH$_2$)]-[2-Nal]-[Aib]-[Lys(Ac)]-NN-NH$_2$ | | | |
| 683 | Ac-[Pen]-NTWQ[Pen]-[Phe(4-CONH$_2$)]-[2-Nal]-[4-amino-4-carboxy-tetrahydropyran]-Lys(Ac)]-NN-NH$_2$ | | | |
| 684 | Ac-[Pen]-NTWQ[Pen]-[Phe(4-CONH$_2$)]-[2-Nal]-[Achc]-[Lys(Ac)]-NH2 | | | |
| 685 | Ac-[Pen]-NTWQ[Pen]-[Phe(4-CONH$_2$)]-[2-Nal]-[Acpc]-[Lys(Ac)]-NN-NH$_2$ | | | |
| 686 | Ac-[Pen]-NTWQ[Pen]-[Phe(4-CONH$_2$)]-[2-Nal]-[α-MeLeu]-[Lys(Ac)]-NN-NH$_2$ | | | |
| 687 | Ac-[Pen]-NTWQ[Pen]-[Phe(4-OMe)]-[2-Nal]-[Aib]-[Lys(Ac)]-NN-NH$_2$ | | | |
| 688 | Ac-[Pen]-NTWQ[Pen]-[Phe(4-OMe)]-[2-Nal]-[4-amino-4-carboxy-tetrahydropyran]-[Lys(Ac)]-NN-NH$_2$ | | | |
| 689 | Ac-[Pen]-NTWQ[Pen]-[Phe(4-OMe)]-[2-Nal]-[Achc]-[Lys(Ac)]-NN-NH$_2$ | | | |
| 730 | Ac-[Pen]-NTWQ[Pen]-[Phe(4-OMe)]-[2-Nal]-[Acpc]-[Lys(Ac)]-NN-NH$_2$ | | | |
| 731 | Ac-[Pen]-NTWQ[Pen]-[Phe(4-OMe)]-[2-Nal]-[α-MeLeu]-[Lys(Ac)]-NN-NH$_2$ | | | |

\* = <10 nM;
\*\* = 10-25 nM
\*\*\* = 25-100 nM,
\*\*\*\* = 100-1000 nM,
\*\*\*\*\* = 1000-10,000 nM.

TABLE 5A

IC50 of Illustrative Peptide Inhibitors (Thioethers)

| SEQ ID NO. | Sequence/Structure | Human ELISA (nM) |
|---|---|---|
| 732 | 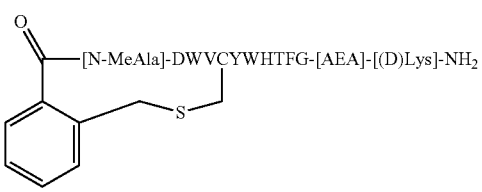 | ~6000 |

TABLE 5A-continued

IC50 of Illustrative Peptide Inhibitors (Thioethers)

| SEQ ID NO. | Sequence/Structure | Human ELISA (nM) |
|---|---|---|
| 733 | 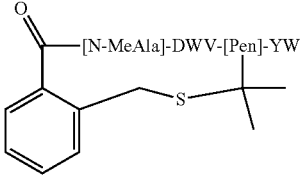—[N-MeAla]-DWV-[Pen]-YWHTFG-[AEA]-[(D)Lys]-NH$_2$ | >30000 |
| 734 | 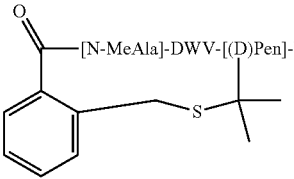—[N-MeAla]-DWV-[(D)Pen]-YWHTFG-[AEA]-[(D)Lys]-NH$_2$ | >30000 |
| 735 | 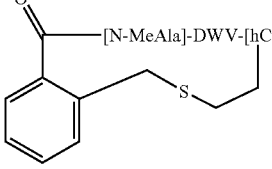—[N-MeAla]-DWV-[hCys]-YWHTFG-[AEA]-[(D)Lys]-NH$_2$ | ~6000 |
| 736 | 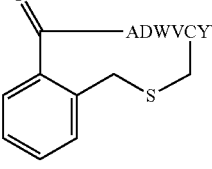—ADWVCYWHTFG-[AEA]-[(D)Lys]-NH$_2$ | ~3000 |
| 737 | 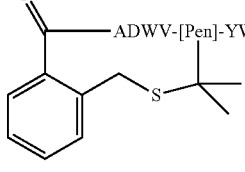—ADWV-[Pen]-YWHTFG-[AEA]-[(D)Lys]-NH$_2$ | >30000 |
| 738 | 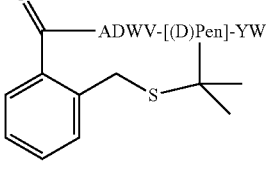—ADWV-[(D)Pen]-YWHTFG-[AEA]-[(D)Lys]-NH$_2$ | >30000 |
| 739 | 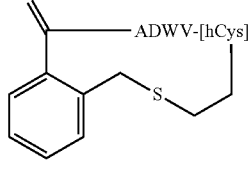—ADWV-[hCys]-YWHTFG-[AEA]-[(D)Lys]-NH$_2$ | ~6000 |
| 740 | 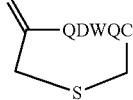—QDWQCYWRENG-[AEA]-[(D)Lys]-NH$_2$ | >6000 |

TABLE 5A-continued

IC50 of Illustrative Peptide Inhibitors (Thioethers)

| SEQ ID NO. | Sequence/Structure | Human ELISA (nM) |
|---|---|---|
| 741 | 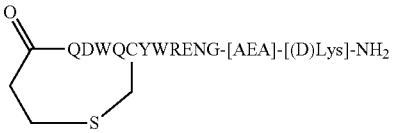 QDWQCYWRENG-[AEA]-[(D)Lys]-NH$_2$ | ~30000 |
| 742 | 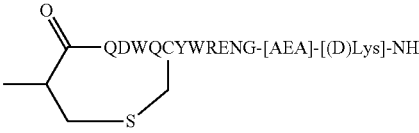 QDWQCYWRENG-[AEA]-[(D)Lys]-NH$_2$ | ~6000 |
| 743 | 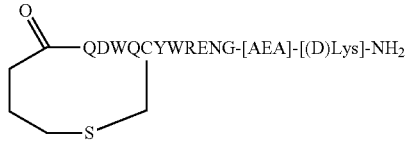 QDWQCYWRENG-[AEA]-[(D)Lys]-NH$_2$ | ~6000 |
| 744 | 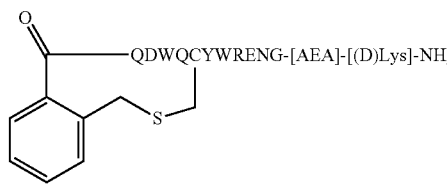 QDWQCYWRENG-[AEA]-[(D)Lys]-NH$_2$ | ~30000 |
| 745 | 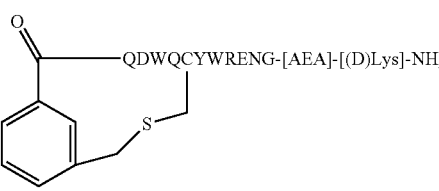 QDWQCYWRENG-[AEA]-[(D)Lys]-NH$_2$ | >6000 |
| 746 | 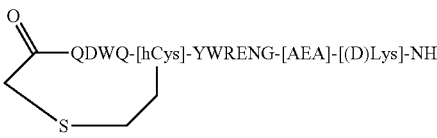 QDWQ-[hCys]-YWRENG-[AEA]-[(D)Lys]-NH$_2$ | >6000 |
| 747 | 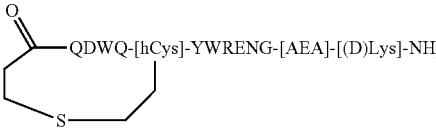 QDWQ-[hCys]-YWRENG-[AEA]-[(D)Lys]-NH$_2$ | >6000 |
| 748 | 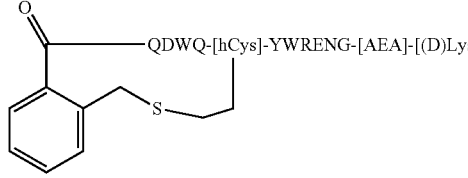 QDWQ-[hCys]-YWRENG-[AEA]-[(D)Lys]-NH$_2$ | >6000 |
| 749 | 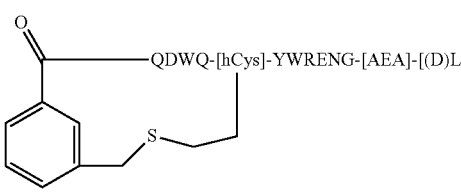 QDWQ-[hCys]-YWRENG-[AEA]-[(D)Lys]-NH$_2$ | ~30000 |

TABLE 5A-continued

IC50 of Illustrative Peptide Inhibitors (Thioethers)

| SEQ ID NO. | Sequence/Structure | Human ELISA (nM) |
|---|---|---|
| 690 | [Structure: 4-acetylbenzyl group linked via thioether to]-QDWQCYWRENG-[AEA]-[(D)Lys]-NH$_2$ | >30000 |
| 691 | [Structure: 4-acetylbenzyl group linked via thioether to]-QDWQ-[hCys]-CYWRENG-[AEA]-[(D)Lys]-NH$_2$ | >30000 |

TABLE 5B

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 692 | Ac-Cyclo-[[Abu]RTWQC]-YWRKFG-[AEA]-[(D)Lys]-NH$_2$ | *** | **** | *** |
| 693 | Ac-Cyclo-[CRTWQ-[Abu]]-YWRKFG-[AEA]-[(D)Lys]-NH$_2$ | **** | **** | *** |
| 694 | Ac-Cyclo-[[Abu]-QTWQC]-YWRENG-[AEA]-[(D)Lys]-NH$_2$ | **** | **** | *** |
| 695 | Ac-Cyclo-[[Abu]-RTWQ-[Pen]]-YWRKFG-[AEA]-[(D)Lys]-NH$_2$ | ***** | | |
| 696 | Ac-Cyclo-[[Pen]-RTWQ-[Abu]]-YWRKFG-[AEA]-[(D) Lys]-NH2 | **** | | |
| 697 | Ac-Cyclo-[[(D)Cys]-RTWQ-[Abu]]-YWRKFG-[AEA]-[(D)-Lys]- NH$_2$ | **** | | |
| 698 | Ac-Cyclo-[[Abu]-QTWQC]-YW-[Orn]-[Dap]-NG-[AEA]-[(D)Lys]-NH$_2$ | **** | | |
| 699 | Ac-Cyclo-[[Abu]-QTWQC]-YW-[hLeu]-ENG-NH$_2$ | *** | | ** |
| 700 | Ac-Cyclo-[Abu]-QTWQ-(D)Cys]]-YW-[hLeu]-ENG-NH$_2$ | ***** | | |
| 701 | Ac-Cyclo-[[Abu]-QTWQ-[Pen]]-YW-[hLeu]-ENG-NH$_2$ | ***** | | |
| 702 | Ac-Cyclo-[[Abu]-QTWQC]-[Phe(4-OMe)]-[2-Nal]-[α-MeLys]-ENG-NH$_2$ | *** | **** | * |
| 703 | Ac-Cyclo-[[Abu]-QTWQC]-YW-[α-MeLeu]-ENG-NH$_2$ | ** | *** | * |
| 704 | Ac-Cyclo-[[Abu]-QTWQC]-Y-[2-Nal]-[α-MeLys]-ENG-NH$_2$ | ** | ** | * |
| 705 | Ac-Cyclo-[[Abu]-QTWQC]-[Phe(4-OMe)]-[2-Nal]-[α-MeLys]-ENG-NH$_2$ | ** | ** | * |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH₂

| SEQ ID NO. | Sequence | Human ELISA (nM) | Rat ELISA (nM) | pStat3 HTRF (nM) |
|---|---|---|---|---|
| 706 | Ac-Cyclo-[[Abu]-QTWQC]-[Phe(4-OMe)]-[2-Nal]-[α-MeOrn]-ENG-NH₂ | ** | *** | * |
| 707 | Ac-Cyclo-[[Abu]-QTWQC]-[Phe(4-OMe)]-W-[α-MeOrn]-ENG-NH₂ | *** | *** | * |
| 708 | Ac-Cyclo-[[Abu]-QTWQC]-[Phe(4-OMe)]-[2-Nal]-[α-MeLys]-ENG-NH₂ | ** | *** | * |
| 709 | Ac-Cyclo-[[Abu]-QTWQC]-[Phe(4-OMe)]-W-[α-MeLys]-[Lys(Ac)]-NG-NH₂ | ** | ** | ** |
| 710 | Ac-Cyclo-[[Abu]-QTWQC]-[Phe(4-OMe)]-W-[α-MeLys]-ENG-NH₂ | ** | *** | ** |
| 711 | Ac-Cyclo-[[Abu]-QTWQC]-[Phe(4-OMe)]-[1-Nal]-[α-MeLys]-[Lys(Ac)]-NG-NH₂ | *** | *** | ** |
| 712 | Ac-Cyclo-[[Abu]-QTWQC]-[Phe(4-OMe)]-[2-Nal]-[α-MeLys]-[Lys(Ac)]-NG-NH₂ | * | ** | * |
| 713 | Ac-Cyclo-[[Abu]-QTWQC]-YW-[α-MeOrn]-[Lys(Ac)]-NG-NH₂ | *** | *** | ** |
| 714 | Ac-Cyclo-[[Abu]-QTWQC]-[Phe(4-OMe)]-[2-Nal]-[(D)Asn]-[Lys(Ac)]-NG-NH₂ | *** | **** | *** |
| 715 | Ac-Cyclo-[[Abu]-QTWQC]-[Phe(4-Phenoxy)]-[2-Nal]-[α-MeLys]-[Lys(Ac)]-NG-NH₂ | **** | | |
| 716 | Ac-Cyclo-[[Abu]-QTWQC]-[hPhe(3,4-dimethoxy)]-[2-Nal]-[α-MeLys]-[Lys(Ac)]-NG-NH₂ | ***** | | |
| 717 | Ac-Cyclo-[[Abu]-QTWQC]-[DMT]-[2-Nal]-[α-MeLys]-[Lys(Ac)]-NG-NH₂ | ***** | | |
| 718 | Ac-Cyclo-[[Abu]-QTWQC]-[Phe(4-CONH₂)]-[2-Nal]-[α-MeLys]-[Lys(Ac)]NG-NH₂ | * | *** | * |
| 719 | Ac-Cyclo-[[Abu]-QTWQC]-Phe(3,4-Cl₂)[2-Nal]-[α-MeLys]-[Lys(Ac)]NG-NH₂ | **** | | *** |
| 720 | Ac-Cyclo-[[Abu]-QTWQ-[Pen]]-[Phe(4-OME)]-[2-Nal]-[α-MeLys]-ENG-NH₂ | **** | **** | *** |
| 721 | Ac-Cyclo-[[Abu]-QTWQ-[Pen]]-[Phe(4-OMe)]-[2-Nal]-[α-MeLys]-[Lys(Ac)]NG-NH₂ | *** | **** | *** |
| 722 | Ac-Cyclo-[[Pen]-QTWQ-[Abu]]-[Phe(4-OMe)]-[2-Nal]-[α-MeLys]-[Lys(Ac)[NG-NH₂ | | | |
| 723 | Ac-Cyclo-[[Abu]-QTWQC]-[Phe(4-OMe)]-[Trp(2,5,7-tri-tert-Butyl)]-[α-MeLys]-ENG-NH₂ | >10,000 | | |
| 724 | Ac-Cyclo-[[Abu]-QTWQC]-[Phe(4-OMe)]- [Phe(4-Oallyl)]-[α-MeLys]-ENG-NH₂ | **** | | |
| 725 | Ac-Cyclo-[[Abu]-QTWQC]-[Phe(4-OMe)]-[Tyr(3-tBu)]-[α-MeLys]-ENG-NH₂ | *** | **** | ** |
| 726 | Ac-Cyclo-[[Abu]-QTWQC]-[Phe(4-OMe)]-[Phe(4-tBu)]-[α-MeLys]-ENG-NH₂ | ***** | | |
| 727 | Ac-Cyclo-[[Abu]-QTWQC]-[Phe(4-OMe)]-[Phe(4-guanidino)]-[α-MeLys]-ENG-NH₂ | **** | | |
| 728 | Ac-Cyclo-[[Abu]-QTWQC]-[Phe(4-OMe)]-[Phe(Bzl)]-[α-MeLys]-ENG-NH₂ | **** | | |
| 729 | Ac-Cyclo-[[Abu]-QTWQC]-[Tyr(3-tBu)]-W-[α-MeLys]-ENG-NH₂ | >10,000 | | |
| 780 | Ac-Cyclo-[[Abu]-QTWQC]-[Phe(4-tBu)]-W-[α-MeLys]-ENG-NH₂ | ***** | | |

TABLE 5B-continued

IC50 of Illustrative Peptide Inhibitors (Thioethers)

Ac-NH-CH(C=O)-XXWX-NH-CH(C=O)-[Phe(4-OMe)]-[2-Nal]XXXX-NH₂ (with S-containing thioether bridge)

Ac-Cyclo-[[Abu]-XXWXC]-[Phe(4-OMe)]-[2-Nal]-XXX-NH₂

| SEQ ID NO. | Sequence | Human ELISA (nM) | Rat ELISA (nM) | pStat3 HTRF (nM |
|---|---|---|---|---|
| 781 | Ac-Cyclo-[[Abu]-QTWQC]-[Phe(4-guanidino)]-W-[α-MeLys]-ENG-NH₂ | *** | *** | *** |
| 782 | Ac-Cyclo-[[Abu]-QTWQC]-[Phe[4-(2-aminoethoxy)]-W-[α-MeLys]-ENG-NH₂ | ** | ** | * |
| 783 | Ac-Cyclo-[[Abu]-QTWQC]-[Phe(4-CO₂H)]-W-[α-MeLys]-ENG-NH₂ | **** | | |
| 784 | Ac-Cyclo-[[Abu]-QTWQC]-[Phe(4-phenoxy)]-W-[α-MeLys]-ENG-NH₂ | *** | *** | ** |
| 785 | Ac-Cyclo-[[Abu]-QTWQC]-[Phe(4-CN)]-W-[α-MeLys]-ENG-NH₂ | *** | | *** |
| 786 | Ac-Cyclo-[[Abu]-QTWQC]-[Phe(4-Br)]-W-[α-MeLys]-ENG-NH₂ | *** | *** | *** |
| 787 | Ac-Cyclo-[[Abu]-QTWQC]-[Phe(4-NH₂)]-W-[α-MeLys]-ENG-NH₂ | *** | *** | * |
| 788 | Ac-Cyclo-[[Abu]-QTWQC]-[Phe(4-OMe)]-Phe(4-Me)-[α-MeLys]-ENG-NH₂ | **** | | |
| 789 | Ac-Cyclo-[[Abu]-QTWQC]-[Phe(4-OMe]-[1-Nal]-[α-MeLys]-ENG-NH₂ | *** | *** | ** |
| 790 | Ac-Cyclo-[[Abu]-QTWQC]-[Phe(4-OMe)]-[2-Nal]-[α-MeOrn]-[Lys(Ac)]-NG-NH₂ | ** | ** | * |
| 791 | Ac-Cyclo-[[Abu]-QTWQC]-[2-Nal]-[2-Nal]-[α-MeOrn]-[Lys(Ac)]-NG-NH₂ | *** | **** | * |
| 792 | Ac-Cyclo-[[Abu]-QTWQC]-[Bip]-[2-Nal]-[α-MeLys]-[Lys(Ac)]-NG-NH₂ | **** | | |
| 793 | Ac-Cyclo-[[Abu]-QTWQC]-Cha-[2-Nal]-[α-MeLys]-[Lys(Ac)]-NG-NH₂ | ***** | | |
| 794 | Ac-Cyclo-[[Abu]-QTWQC]-[2-Nal]-[2-Nal]-[α-MeLys]-[Lys(Ac)]-NG-NH₂ | *** | *** | ** |
| 795 | Ac-Cyclo-[[Abu]-QTWQC]-[4-Pyridylalanine]-[2-Nal]-[α-MeLys]-[Lys(Ac)]-NG-NH₂ | **** | | |
| 796 | Ac-Cyclo-[[Abu]-QTWQC]-[β-homoTyr]-[2-Nal]-[α-MeLys]-[Lys(Ac)]-NG-NH₂ | ~10000 | | |
| 797 | Ac-Cyclo-[[Abu]-QTWQC]-[Phe(4-CONH₂)]-[2-Nal]-[α-MeLys]-[Lys(Ac)]-NG-NH₂ | ** | ** | * |
| 798 | Ac-Cyclo-[[Abu]-QTWQC]-[2-Nal]-[2-Nal]-[α-MeLys]-ENG-NH₂ | *** | *** | |
| 799 | Ac-Cyclo-[[Abu]-QT-[2-Nal]-QC]-[Phe(4-OMe)]-[2-Nal]-[α-MeLys]-[Lys(Ac)]-NG-NH₂ | **** | | |
| 800 | Ac-Cyclo-[[Abu]-QT-[1-Nal]-QC]-[Phe(4-OMe)]-[2-Nal]-[α-MeLys]-[Lys(Ac)]-NG-NH₂ | **** | | |
| 801 | Ac-Cyclo-[[Abu]-QTYQC]-[Phe(4-OMe)]-[2-Nal]-[α-MeLys]-[Lys(Ac)]-NG-NH₂ | ~10000 | | |
| 802 | Ac-Cyclo-[[Abu]-QTWQC]-[Phe(4-OMe)]-[2-Nal]-[α-MeLys]-[Lys(Ac)]-NG-NH₂ | | | |
| 803 | Ac-Cyclo-[[Abu]-QTWQC]-[Phe(4-OMe)]-[2-Nal]-[α-MeLys]-[Lys(Ac)]-NGGE-NH₂ | *** | | |
| 804 | Ac-Cyclo-[[Abu]-QTWQC]-[Phe(4-OMe)]-[2-Nal]-[α-MeLys]-[Lys(Ac)]-NGAE-NH₂ | | | |
| 805 | Ac-Cyclo-[[Abu]-STWQC]-[Phe(4-OMe)]-[2-Nal]-[α-MeLys]-[Lys(Ac)]-NGGE-NH₂ | | | |
| 806 | Ac-Cyclo-[[Abu]-QTWQC]-[Phe(4-OMe)]-W-[α-MeLys]-[Lys(Ac)]-NGGE-NH₂ | | | |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 807 | Ac-Cyclo-[[Abu]-QTWQC]-Y-[2-Nal]-[α-MeLys]-[Lys(Ac)]-NGGE-NH$_2$ | | | |
| 808 | Ac-Cyclo-[[Abu]-QTWQC]-[Phe(4-OMe)]-[2-Nal]-[α-MeLys]-[Lys(Ac)]-NS-NH$_2$ | ** | ** | * |
| 809 | Ac-Cyclo-[[Abu]-QTWQC]-[Phe(4-OMe)]-[2-Nal]-[α-MeLys]-[Lys(Ac)]-NA-NH$_2$ | * | ** | * |
| 810 | Ac-Cyclo-[[Abu]-QTWQC]-[Phe(4-OMe)]-[2-Nal]-[Aib]-[Lys(Ac)]-NG-NH$_2$ | ** | *** | * |
| 811 | Ac-Cyclo-[[Abu]-QTWQC]-[Phe-4-N$_3$]-[2-Nal]-[α-MeLys]-[Lys(Ac)]-NG-NH$_2$ | *** | *** | ** |
| 812 | Ac-Cyclo-[[Abu]-QTWQC]-[Phe(4-OMe)]-[2-Nal]-[α-MeLys]-[Lys(Ac)]-QG-NH$_2$ | *** | *** | * |
| 813 | Ac-Cyclo-[[Abu]-QTWQC]-[Phe(4-OMe)]-[2-Nal]-[α-MeLys]-[Lys(Ac)]-[Cit]-G-NH$_2$ | | | |
| 814 | Ac-Cyclo-[[Abu]-QTWQC]-[Phe(4-OMe)]-[2-Nal]-[α-MeLys]-VNG-NH$_2$ | *** | *** | * |
| 815 | Ac-Cyclo-[[Abu]-QTWQC]-[Phe(4-OMe)]-[2-Nal]-[Orn]-[Lys(Ac)]-NG-NH$_2$ | **** | | |
| 816 | Ac-Cyclo-[[Abu]-QTWQC]-[Phe(4-OMe)]-[2-Nal]-[Orn]-[Dap]-NG-NH$_2$ | **** | | |
| 817 | Ac-Cyclo-[[Abu]-NTWQC]-[Phe(4-OMe)]-[2-Nal]-[α-MeLys]-[Lys(Ac)]-NG-NH$_2$ | ** | *** | * |
| 818 | Ac-Cyclo-[[Abu]-QT-[Bip]-QC]-[Phe(4-OMe)]-[2-Nal]-[α-MeLys]-[Lys(Ac)]-NG-NH$_2$ | ~10000 | | |
| 819 | Ac-Cyclo-[[Abu]-QTWQC]-[Phe(4-OMe)]-[2-Nal]-[Cha]-[Lys(Ac)]-NG-NH$_2$ | *** | *** | * |
| 820 | Ac-Cyclo-[[Abu]-QTWQC]-[Phe(4-OMe)]-[2-Nal]-[Chg]-[Lys(Ac)]-NG-NH$_2$ | *** | | |
| 821 | Ac-Cyclo-[[Abu]-QT-[Octgly]-QC]-[Phe(4-OMe)]-[2-Nal]-[α-MeLys]-[Lys(Ac)]-NG-NH$_2$ | >10000 | | |
| 822 | Ac-Cyclo-[[Abu]-QTWQC]-[Octgly]-[2-Nal]-[α-MeLys]-[Lys(Ac)]-NG-NH$_2$ | ~10000 | | |
| 823 | Ac-Cyclo-[[Abu]-QTWQC]-[Phe(4-OMe)]-[Octgly]-[α-MeLys]-[Lys(Ac)]-NG-NH$_2$ | ~10000 | | |
| 824 | Ac-Cyclo-[[Abu]-QTWQC]-[Phe(4-OMe)]-[2-Nal]-[α-MeLys]-[Lys(Ac)]-NGE-NH$_2$ | *** | *** | * |
| 825 | Ac-Cyclo-[[Abu]-QTWQC]-[Phe(4-OMe)]-[2-Nal]-[α-MeLys]-[Lys(Ac)]-NAE-NH$_2$ | * | ** | * |
| 826 | Ac-Cyclo-[[Abu]-STWQC]-[Phe(4-OMe)]-[2-Nal]-[α-MeLys]-[Lys(Ac)]-NGE-NH$_2$ | *** | *** | *** |
| 827 | Ac-Cyclo-[[Abu]-QTWQC]-[Phe(4-OMe)]-W-[α-MeLys]-[Lys(Ac)]-NGE-NH$_2$ | **** | | |
| 828 | Ac-Cyclo-[[Abu]-QTWQC]-Y-[2-Nal]-[α-MeLys]-[Lys(Ac)]-NGE-NH$_2$ | *** | | |
| 829 | Ac-Cyclo-[[Abu]-QTWQC]-[Phe[4-(2-aminoethoxy)]]-[2-Nal]-[α-MeLys]-ENG-NH$_2$ | * | * | * |
| 830 | Ac-Cyclo-[[Abu]-QTQQC]-[Phe[4-(2-aminoethoxy)]]-[2-Nal]-[α-MeLys]-ENG-NH$_2$ | >3000 | | |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 831 | Ac-Cyclo-[[Abu]-QTHQC]-[Phe[4-(2-aminoethoxy)]]-[2-Nal]-[α-MeLys]-ENG-NH$_2$ | >3000 | | |
| 832 | Ac-Cyclo-[[Abu]-QT-[hPhe]-QC]-[Phe[4-(2-aminoethoxy)]]-[2-Nal]-[α-MeLys]-ENG-NH$_2$ | >3000 | | |
| 833 | Ac-Cyclo-[[Abu]-QT-[Glu(Bzl)]-QC]-[Phe[4-(2-aminoethoxy)]]-[2-Nal]-[α-MeLys]-ENG-NH$_2$ | >3000 | | |
| 834 | Ac-Cyclo-[[Abu]-QT-[Bip]-QC]-[Phe[4-(2-aminoethoxy)]]-[2-Nal]-[α-MeLys]-ENG-NH$_2$ | >3000 | | |
| 835 | Ac-Cyclo-[[Abu]-QT-[Tic]-QC]-[Phe[4-(2-aminoethoxy)]]-[2-Nal]-[α-MeLys]-ENG-NH$_2$ | >3000 | | |
| 836 | Ac-Cyclo-[[Abu]-QT-[Phe[4-(2-aminoethoxy)]]-QC]-[Phe[4-(2-aminoethoxy)]]-[2-Nal]-[α-MeLys]-ENG-NH$_2$ | >3000 | | |
| 837 | Ac-Cyclo-[[Abu]-QT-[Phe(3,4-Cl2)]-QC]-[Phe[4-(2-aminoethoxy)]]-[2-Nal]-[α-MeLys]-ENG-NH$_2$ | >3000 | | |
| 838 | Ac-Cyclo-[[Abu]-QT-[Phe(4-OMe)]-QC]-[Phe[4-(2-aminoethoxy)]]-[2-Nal]-[α-MeLys]-ENG-NH$_2$ | >3000 | | |
| 839 | Ac-Cyclo-[[Abu]-QT-[Orn(Benzyl)]-QC]-[Phe[4-(2-aminoethoxy)]]-[2-Nal]-[α-MeLys]-ENG-NH$_2$ | >3000 | | |
| 840 | Ac-Cyclo-[[Abu]-QT-[Orn(Benzaldehyde)]-QC]-Phe[4-(2-aminoethoxy)]]-[2-Nal]-[α-MeLys]-ENG-NH$_2$ | | | |
| 841 | Ac-Cyclo-[[Abu]-QTWQC]-[PheOCH2CH2NHAc]-[2-Nal]-[α-MeLys]-ENG-NH$_2$ | | | |
| 842 | Ac-Cyclo-[[Abu]-QTWQC]-[Phe[4-(2-aminoethoxy)]]-[2-Nal]-[α-MeLeu]-ENG-NH$_2$ | | | |
| 843 | Ac-Cyclo-[[Abu]-QT-[5-hydroxyTrp]-QC]-[Phe[4-(2-aminoethoxy)]]-[2-Nal]-[α-MeLys]-ENG-NH$_2$ | ~3000 | | |
| 844 | Ac-Cyclo-[[Abu]-QT-[6-chloroTrp]-QC]-[Phe[4-(2-aminoethoxy)]]-[2-Nal]-[α-MeLys]-ENG-NH$_2$ | ** | ** | * |
| 845 | Ac-Cyclo-[[Abu]-QT-[N-MeTrp]-QC]-[Phe[4-(2-aminoethoxy)]]-[2-Nal]-[α-MeLys]-ENG-NH$_2$ | >3000 | | |
| 846 | Ac-Cyclo-[[Abu]-QT-[1,2,3,4-tetrahydro-norharman]-QC]-[Phe[4-(2-aminoethoxy)]]-[2-Nal]-[α-MeLys]-ENG-NH$_2$ | **** | | |
| 847 | Ac-Cyclo-[[Abu]-QT-[Phe(4-CO2H)]-QC]-[Phe[4-(2-aminoethoxy)]]-[2-Nal]-[α-MeLys]-ENG-NH$_2$ | >3000 | | |
| 848 | Ac-Cyclo-[[Abu]-QT-[Phe(4-CONH2)]-QC]-[Phe[4-(2-aminoethoxy)]]-[2-Nal]-[α-MeLys]-ENG-NH$_2$ | >3000 | | |
| 849 | Ac-Cyclo-[[Abu]-QT-[Phe(4-CONH2)]-QC]-[Phe[4-(2-aminoethoxy)]]-[2-Nal]-[α-MeLys]-ENG-NH$_2$ | >3000 | | |
| 850 | Ac-Cyclo-[[Abu]-QT-[Phe(3,4-OMe)]-QC]-[Phe[4-(2-aminoethoxy)]]-[2-Nal]-[α-MeLys]-ENG-NH$_2$ | ~3000 | | |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH₂

| SEQ ID NO. | Sequence | Human ELISA (nM) | Rat ELISA (nM) | pStat3 HTRF (nM |
|---|---|---|---|---|
| 851 | Ac-Cyclo-[[Abu]-QT-[α-MePhe]-QC]-[Phe[4-(2-aminoethoxy)]]-[2-Nal]-[α-MeLys]-ENG-NH₂ | **** | | |
| 852 | Ac-Cyclo-[[Abu]-QT-[Phe(4-CF3)]-QC]-[Phe[4-(2-aminoethoxy)]]-[2-Nal]-[α-MeLys]-ENG-NH₂ | ~3000 | | |
| 853 | Ac-Cyclo-[[Abu]-QT-[Phe(4-tBu)]-QC]-[Phe[4-(2-aminoethoxy)]]-[2-Nal]-[α-MeLys]-ENG-NH₂ | >3000 | | |
| 854 | Ac-Cyclo-[[Abu]-QT-[Phe(2,4-Me2)]-QC]-[Phe[4-(2-aminoethoxy)]]-[2-Nal]-[α-MeLys]-ENG-NH₂ | **** | | |
| 855 | Ac-Cyclo-[[Abu]-QTWQC]-[Phe[4-(2-aminoethoxy)]]-[2-Nal]-[α-MeLys]-DNG-NH₂ | * | ** | * |
| 856 | Ac-Cyclo-[[Abu]-QTWQC]-[Phe[4-(2-aminoethoxy)]]-[2-Nal]-[α-MeLys]-QNG-NH₂ | * | | * |
| 857 | Ac-Cyclo-[[Abu]-QTWQC]-[Phe[4-(2-aminoethoxy)]]-[2-Nal]-[α-MeLys]-[Lys(Benzoic acid)]-NG-NH₂ | * | | * |
| 858 | Ac-Cyclo-[[Abu]-QTWQC]-[Phe[4-(2-aminoethoxy)]]-[2-Nal]-[α-MeLys]-[Lys(succinic acid)]-NG-NH₂ | * | ** | * |
| 859 | Ac-Cyclo-[[Abu]-QTWQC]-[Phe[4-(2-aminoethoxy)]]-[2-Nal]-[α-MeLys]-[Lys(glutaric acid)]-NG-NH₂ | * | | * |
| 860 | Ac-Cyclo-[[Abu]-QTWQC]-[Phe[4-(2-aminoethoxy)]]-[2-Nal]-[α-MeLys]-[Lys(pyroglutamic acid)]-NG-NH₂ | * | | * |
| 861 | Ac-Cyclo-[[Abu]-QTWQC]-[Phe[4-(2-aminoethoxy)]]-[2-Nal]-[α-MeLys]-[Lys(isovaleric acid)]-NG-NH₂ | * | ** | * |
| 862 | Ac-Cyclo-[[Abu]-QTWQC]-[Phe[4-(2-aminoethoxy)]]-[2-Nal]-[α-MeLys]-[Lys(Palm)]-NG-NH₂ | ~3000 | | |
| 863 | Ac-Cyclo-[[Abu]-QTWQC]-[Phe[4-(2-aminoethoxy)]]-[2-Nal]-[α-MeLys]-Lys[(PEG1)]-NG-NH₂ | | | |
| 864 | Ac-Cyclo-[[Abu]-QTWQC]-[Phe[4-(2-aminoethoxy)]]-[2-Nal]-[α-MeLys]-[Lys(PEG2)]-NG-NH₂ | | | |
| 865 | Ac-Cyclo-[[Abu]-QTWQC]-[Phe[4-(2-aminoethoxy)]]-[2-Nal]-[α-MeLys]-[Dap(Benzoic acid)]-NG-NH₂ | | | |
| 866 | Ac-Cyclo-[[Abu]-QTWQC]-[Phe[4-(2-aminoethoxy)]]-[2-Nal]-[α-MeLys]-[Dap(succinic acid)]-NG-NH₂ | | | |
| 867 | Ac-Cyclo-[[Abu]-QTWQC]-[Phe[4-(2-aminoethoxy)]]-[2-Nal]-[α-MeLys]-[Dap(glutaric acid)]-NG-NH₂ | | | |
| 868 | Ac-Cyclo-[[Abu]-QTWQC]-[Phe[4-(2-aminoethoxy)]]-[2-Nal]-[α-MeLys]-[Dap(pyroglutamic acid)]-NG-NH₂ | ** | | * |
| 869 | Ac-Cyclo-[[Abu]-QTWQC]-[Phe[4-(2-aminoethoxy)]]-[2-Nal]-[α-MeLys]-Dap(IVA)NG-NH₂ | | | |
| 870 | Ac-Cyclo-[[Abu]-QTWQC]-[Phe[4-(2-aminoethoxy)]]-[2-Nal]-[α-MeLys]-[Dap(PEG1)]-NG-NH₂ | | | |
| 871 | Ac-Cyclo-[[Abu]-QTWQC]-[Phe[4-(2-aminoethoxy)]]-[2-Nal]-[α-MeLys]-[Dap(PEG2)]-NG-NH₂ | | | |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM) |
|---|---|---|---|---|
| 872 | Ac-Cyclo-[[Abu]-QTWQC]-[Phe[4-(2-aminoethoxy)]]-[2-Nal]-[α-MeLys]-[Dap(PEG2-Ac)]-NG-NH$_2$ | ** | | ** |
| 873 | Ac-Cyclo-[[Abu]-QTWQC]-[Phe[4-(2-aminoethoxy)]]-[2-Nal]-[α-MeLys]-[Lys(Ac)]--NG-[AEA]-[(D)Lys]-NH$_2$ | * | | * |
| 874 | Ac-Cyclo-[[Abu]-QTWQC]-[Phe[4-(2-aminoethoxy)]]-[2-Nal]-[α-MeLys]-[Lys(Ac)]-NG-[(D)Lys]-NH$_2$ | * | | * |
| 875 | Ac-Cyclo-[[Abu]-QTWQC]-[Phe[4-(2-aminoethoxy)]]-[2-Nal]-[α-MeLys]-[Lys(Ac)]-NG-[AEA]-NH$_2$ | * | | * |
| 876 | Ac-Cyclo-[[Abu]-QTWQC]-[Phe[4-(2-aminoethoxy)]]-[2-Nal]-[Aib]-[Lys(Ac)]-QG-NH$_2$ | ** | | * |
| 877 | Ac-Cyclo-[[Abu]-QTWQC]-[Phe[4-(2-aminoethoxy)]]-[2-Nal]-[Aib]-QNG-NH$_2$ | * | ** | * |
| 878 | Ac-Cyclo-[[Abu]-QTWQC]-[Phe[4-(2-aminoethoxy)]]-[2-Nal]-[Aib]-ENG-NH$_2$ | * | | * |
| 879 | Ac-Cyclo-[[Abu]-QTWQC]-[Phe[4-(2-aminoethoxy)]]-1-Nal[Aib]-[Lys(Ac)]-NG-NH$_2$ | *** | | ** |
| 880 | Ac-Cyclo-[[Abu]-QTWQC]-[Phe[4-(2-aminoethoxy)]]-[2-Nal]-[Aib]-[Lys(Ac)]-NA-NH$_2$ | * | ** | * |
| 881 | Ac-Cyclo-[[Abu]-QTWQC]-[Phe[4-(2-aminoethoxy)]]-[2-Nal]-[Aib]-KNG-NH$_2$ | * | | * |
| 882 | Ac-Cyclo-[[Abu]-QTWQC]-[Phe[4-(2-aminoethoxy)]]-[Phe(4-CO$_2$H)]-[α-MeLys]-[Lys(Ac)]-NG-NH$_2$ | **** | | |
| 883 | Ac-Cyclo-[[Abu]-[Dap]-TWQC]-[Phe[4-(2-aminoethoxy)]]-[Phe(4-Phenoxy)]-[α-MeLys]-[Lys(Ac)]-NG-NH$_2$ | **** | | |
| 884 | Ac-Cyclo-[[Abu]-DapTWQC]-[Phe[4-(2-aminoethoxy)]]-[Phe[4-(2-aminoethoxy)]]-[α-MeLys]-[Lys(Ac)]-NG-NH$_2$ | **** | | |
| 885 | Ac-Cyclo-[[Abu]-QTWQC]-[Phe[4-(2-aminoethoxy)]]-[α-MeLys]-[Lys(Ac)]-NG-NH$_2$ | >3000 | | |
| 886 | Ac-Cyclo-[[Abu]-DabTWQC]-[Phe[4-(2-aminoethoxy)]]-[hPhe]-[α-MeLys]-[Lys(Ac)]-NG-NH$_2$ | >1000 | | |
| 887 | Ac-Cyclo-[[Abu]-DapTWQC]-[Phe[4-(2-aminoethoxy)]]-[Glu(Bzl)]-[α-MeLys]-[Lys(Ac)]-NG-NH$_2$ | >3000 | | |
| 888 | Ac-Cyclo-[[Abu]-QTWQC]-[Phe[4-(2-aminoethoxy)]]-W-[α-Me-Orn]-ENG-NH$_2$ | ** | | * |
| 889 | Ac-Cyclo-[[Abu]-QTWQC]-[Phe[4-(2-aminoethoxy)]]-W-[α-MeLys]-[Lys(Ac)]-NG-NH$_2$ | * | | * |
| 890 | Ac-Cyclo-[[Abu]-QTWQC]-[Phe[4-(2-aminoethoxy)]]-W-[α-Me-Orn]-[Lys(Ac)]-NG-NH$_2$ | ** | | ** |
| 891 | Ac-Cyclo-[[Abu]-QTWQC]-[Phe[4-(2-aminoethoxy)]]-[2-Nal]-[α-Me-Orn]-[Lys(Ac)]-NG-NH$_2$ | * | | * |
| 892 | Ac-Cyclo-[[Abu]-QTWQC]-[Phe[4-(2-aminoethoxy)]]-[2-Nal]-[α-MeLys]-[Lys(Ac)]-NG-NH$_2$ | * | * | * |
| 893 | Ac-Cyclo-[[Abu]-QTWQC]-[Phe[4-(2-aminoethoxy)]]-[2-Nal]-[Orn[Lys(Ac)]-NG-NH$_2$ | ** | | ** |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 894 | Ac-Cyclo-[[Abu]-QTWQC]-[Phe[4-(2-aminoethoxy)]]-W-[Orn]-ENG-NH$_2$ | *** | | |
| 895 | Ac-Cyclo-[[Abu]-QTWQC]-[Phe[4-(2-aminoethoxy)]]-W-[Orn]-[Dap]-NG-NH$_2$ | **** | | |
| 896 | Ac-Cyclo-[[Abu]-QTWQC]-[Phe[4-(2-aminoethoxy)]]-W-[Orn]-[Dap(Ac)]-NG-NH$_2$ | **** | | |
| 897 | Ac-Cyclo-[[Abu]-QTWQC]-[Phe[4-(2-aminoethoxy)]]-[2-Nal]-[Orn]-[Dap]-NG-NH$_2$ | *** | | *** |
| 898 | Ac-Cyclo-[[Abu]-QTWQC]-[Phe[4-(2-aminoethoxy)]]-[2-Nal]-[Orn]-[Dap(Ac)]-NG-NH$_2$ | *** | | |
| 899 | Ac-Cyclo-[[Abu]-QTWQC]-[Phe[4-(2-aminoethoxy)]]-W-[hLeu]-ENG-NH$_2$ | ** | | * |
| 900 | Ac-Cyclo-[[Abu]-QTWQC]-[Phe[4-(2-(acetyl-aminoethoxy)]]-[2-Nal]-[α-MeLys(Ac)]-[Lys(Ac)]-NG-NH$_2$ | * | * | * |
| 901 | Ac-Cyclo-[[Abu]-QTWQC]-[Phe[4-(2-aminoethoxy)]]-W-[α-Me-Leu]-ENG-NH$_2$ | * | | * |
| 902 | Succicinyl-Cyclo-[[Abu]-QTWQC]-[Phe[4-(2-aminoethoxy)]]-[2-Nal]-[α-MeLys]-[Lys(Ac)]-NG-NH$_2$ | * | * | * |
| 903 | Ac-Cyclo-[[Abu]-QTWQC]-[Phe[4-(2-aminoethoxy)]]-W-[α-MeLys]-[Lys(Ac)]-[Dap]-G-NH$_2$ | ***** | | |
| 904 | Ac-Cyclo-[[Abu]-QTWQC]-[Phe[4-(2-aminoethoxy)]]-W-[α-MeLys]-[Lys(Ac)]-[6-amino-1,4-diazepane-2,5-dione]-NH$_2$ | *** | | * |
| 905 | Ac-Cyclo-[[Abu]-QTWQC]-[Phe[4-(2-aminoethoxy)]]-W-Chg-[Lys(Ac)]-NG-NH$_2$ | *** | | |
| 906 | Ac-Cyclo-[[Abu]-QTWQC]-[Phe[4-(2-(acetyl-aminoethoxy)]]-[2-Nal]-[α-MeLys(Ac)]-ENG-NH$_2$ | * | * | * |
| 907 | Ac-Cyclo-[[Abu]-QTWQC]-[Phe[4-(2-aminoethoxy)]]-[Phe(4-CONH$_2$)]-[α-MeLys]-[Lys(Ac)]-NG-NH$_2$ | **** | | |
| 908 | Ac-Cyclo-[[Abu]-QTWQC]-[Phe[4-(2-aminoethoxy)]]-[Phe(3,4-OMe$_2$)]-[α-MeLys]-[Lys(Ac)]-NG-NH$_2$ | ** | *** | * |
| 909 | Ac-Cyclo-[[Abu]-[Dap]-TWQC]-[Phe[4-(2-aminoethoxy)]]-[Tic]-[α-MeLys]-[Lys(Ac)]-NG-NH$_2$ | >3000 | | |
| 910 | Ac-Cyclo-[[Abu]-DapTWQC]-[Phe[4-(2-aminoethoxy)]]-[Phe(3,4-Cl$_2$)]-[α-MeLys]--[Lys(Ac)]-NG-NH$_2$ | *** | | |
| 911 | Ac-Cyclo-[[Abu]-QTWQC]-[Phe[4-(2-aminoethoxy)]]-[2-Nal]-[α-MeLys]-ENQ-NH$_2$ | * | * | * |
| 912 | Ac-Cyclo-[[Abu]-QTWQC]-[Phe[4-(2-aminoethoxy)]]-[2-Nal]-[α-MeLys]-ENN-NH$_2$ | * | * | * |
| 913 | Ac-Cyclo-[[Abu]-TTWQC]-[Phe[4-(2-aminoethoxy)]]-[2-Nal]-[α-MeLys]-ENG-NH$_2$ | * | | * |
| 914 | Ac-Cyclo-[[Abu]-QTWQC]-[Phe[4-(2-aminoethoxy)]]-[2-Nal]-[α-Me-Gly(Ethyl)]Lys(Ac)]-NG-NH$_2$ | * | | * |
| 915 | Ac-Cyclo-[[Abu]-QTWQC]-[Phe[4-(2-aminoethoxy)]]-[2-Nal]-[α-MeVal]-[Lys(Ac)]-NG-NH$_2$ | * | * | * |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 916 | Ac-Cyclo-[[Abu]-QTWQC]-[Phe[4-(2-aminoethoxy)]]-[2-Nal]-[α-MeSer]-[Lys(Ac)]-NG-NH$_2$ | * | | * |
| 917 | Ac-Cyclo-[[Abu]-QTDapQC]-[Phe[4-(2-aminoethoxy)]]-[2-Nal]-[α-MeLys]-[Lys(Ac)]-NG-NH$_2$ | >3000 | | |
| 918 | Ac-Cyclo-[[Abu]-QTWQC]-[Phe[4-(2-aminoethoxy)]]-[Dap]-[α-MeLys]-[Lys(Ac)]-NG-NH$_2$ | >3000 | | |
| 919 | Ac-Cyclo-[[Abu]-QTRQC]-[Phe[4-(2-aminoethoxy)]]-[2-Nal]-[α-MeLys]-[Lys(Ac)]-NG-NH$_2$ | >3000 | | |
| 920 | Ac-Cyclo-[[Abu]-QTWQC]-[Phe[4-(2-aminoethoxy)]]-R-[α-MeLys]-[Lys(Ac)]-NG-NH$_2$ | >3000 | | |
| 921 | Ac-Cyclo-[[Abu]-QTDapQC]-[Phe[4-(2-aminoethoxy)]]-[Dap[[α-MeLys]-[Lys(Ac)]-NG-NH$_2$ | >3000 | | |
| 922 | Ac-Cyclo-[[Abu]-QTDQC]-[Phe[4-(2-aminoethoxy)]]-[2-Nal]-[α-MeLys]-[Lys(Ac)]-NG-NH$_2$ | >3000 | | |
| 923 | Ac-Cyclo-[[Abu]-QTWQC]-[Phe[4-(2-aminoethoxy)]]-D-[α-MeLys]-[Lys(Ac)]-NG-NH$_2$ | >3000 | | |
| 924 | Ac-Cyclo-[[Abu]-QTDQC]-[Phe[4-(2-aminoethoxy)]]-D-[α-MeLys]-[Lys(Ac)]-NG-NH$_2$ | >3000 | | |
| 925 | Ac-(D)Lys-[Cyclo-[[Abu]-QTWQC]]-[Phe(4-OMe)]-[2-Nal]-[α-MeLeu]-ENG-NH$_2$ | * | ** | * |
| 926 | Ac-Cyclo-[[Abu]-QTWQC]-[Phe[4-(2-aminoethoxy)]]-[2-Nal]-[α-MeLys]-RNG-NH$_2$ | ** | | * |
| 927 | Ac-Cyclo-[[Abu]-QTWQC]-[Phe[4-(2-aminoethoxy)]]-[2-Nal]-[α-MeLys]-[Orn]-NG-NH$_2$ | * | | * |
| 928 | Ac-Cyclo-[[Abu]-QTWQC]-[Phe[4-(2-aminoethoxy)]]-[2-Nal]-[α-MeLys]-KNG-NH$_2$ | * | | * |
| 929 | Ac-Cyclo-[[Abu]-QTWQC]-[Phe[4-(2-aminoethoxy)]]-[2-Nal]-[α-MeLys]-hRNG-NH$_2$ | * | | * |
| 930 | Ac-Cyclo-[[Abu]-QTWQC]-[Phe[4-(2-aminoethoxy)]]-[2-Nal]-[hLeu]-[Lys(Ac)]-N-[βAla]-NH$_2$ | * | * | * |
| 931 | Ac-Cyclo-[[Abu]-QTWQC]-[Phe[4-(2-aminoethoxy)]]-[2-Nal]-[Cit]-[Dap]-NG-NH$_2$ | ** | | * |
| 932 | Ac-Cyclo-[[Abu]-[α-Me-Orn]-TWQC]-[Phe[4-(2-aminoethoxy)]]-[2-Nal]-[α-MeLys]-ENG-NH$_2$ | *** | | ** |
| 933 | Ac-Cyclo-[[Abu]-QTWQC]-[Phe[4-(2-aminoethoxy)]]-[2-Nal]-[α-MeLys]-NNG-NH$_2$ | * | | * |
| 934 | Ac-Cyclo-[[Abu]-STWQC]-[Phe[4-(2-aminoethoxy)]]-[2-Nal]-[α-MeLys]-KNGGE-NH$_2$ | **** | | |
| 935 | Ac-Cyclo-[[Abu]-QTWQC]-[Phe[4-(2-(acetyl-aminoethoxy)]]-[2-Nal]-[α-MeLys(Ac)]-ENQ-NH$_2$ | * | | * |
| 936 | Ac-Cyclo-[[Abu]-QTWQC]-[Phe[4-(2-(acetyl-aminoethoxy)]]-[2-Nal]-[α-MeLys(Ac)]-ENN-NH$_2$ | * | * | * |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 937 | Ac-Cyclo-[[Abu]-TWQC]-[Phe[4-(2-aminoethoxy)]]-[2-Nal]-[α-MeLys]-ENG-NH$_2$ | | | |
| 938 | Ac-Cyclo-[[Abu]-QTWQC]-[Phe(4-Me)]-[2-Nal]-[α-MeLys]-[Lys(Ac)]-NG-NH$_2$ | * | | * |
| 939 | Ac-Cyclo-[[Abu]-QTWQC]-[Phe(3-Me)]-[2-Nal]-[α-MeLys]-[Lys(Ac)]-NG-NH$_2$ | ** | | * |
| 940 | Ac-Cyclo-[[Abu]-QTWQC]-[hTyr]-[2-Nal]-[α-MeLys]-[Lys(Ac)]-NG-NH$_2$ | ***** | | |
| 941 | Ac-Cyclo-[[Abu]-QTWQC]-[Phe[4-(2-aminoethoxy)]]-[α-MeTrp]-[α-MeLys]-[Lys(Ac)]-NG-NH$_2$ | ~3000 | | |
| 942 | Ac-Cyclo-[[Abu]-[α-MeSer]-TWQC]-[Phe[4-(2-aminoethoxy)]]-[2-Nal]-[α-MeLys]-[Lys(Ac)]-NG-NH$_2$ | *** | | ** |
| 943 | Ac-Cyclo-[[Abu]-Q-[α-MeSer]-WQC]-[Phe[4-(2-aminoethoxy)]]-[2-Nal]-[α-MeLys]-[Lys(Ac)]-NG-NH$_2$ | >3000 | | |
| 944 | Ac-Cyclo-[[Abu]-QTWQC]-[Phe[4-(2-aminoethoxy)]]-[α-MePhe]-[α-MeLys]-[Lys(Ac)]-NG-NH$_2$ | >3000 | | |
| 945 | Ac-Cyclo-[[Abu]-QTWQC]-[Phe[4-(2-aminoethoxy)]-W-[Aib]-ENG-NH$_2$ | ** | | * |
| 946 | Ac-Cyclo-[[Abu]-QTWQC]-[Phe[4-(2-aminoethoxy)]]-[2-Nal]-[Aib]-Lys(Ac)]-NG-NH$_2$ | * | | * |
| 947 | Ac-Cyclo-[[Abu]-QTWQC]-[Phe[4-(2-aminoethoxy)]]-[2-Nal]-[Aib]-E-[Dap(Ac)]-G-NH$_2$ | ** | | * |
| 948 | Ac-Cyclo-[[Abu]-QTWQC]-[Phe[4-(2-aminoethoxy)]]-[2-Nal]-[Aib]-E-[Dab(Ac)]-G-NH$_2$ | * | * | * |
| 949 | Ac-Cyclo-[[Abu]-QTWQC]-[Phe[4-(2-aminoethoxy)]]-[2-Nal]-[Aib]-E-[Lys(Ac)]-G-NH$_2$ | ** | | * |
| 950 | Ac-Cyclo-[[Abu]-QTWQC]-[Phe[4-(2-aminoethoxy)]-W-[Aib]-ENN-NH$_2$ | ** | | * |
| 951 | Ac-Cyclo-[[Abu]-QTWQC]-[Phe[4-(2-aminoethoxy)]]-[2-Nal]-[α-MeLeu]-ENN-NH$_2$ | * | * | * |
| 952 | Ac-Cyclo-[[Abu]-QTWQC]-[Phe[4-(2-aminoethoxy)]]-[Phe(3,4-OMe$_2$)]-[Aib]-ENG-NH$_2$ | *** | | ** |
| 953 | Ac-Cyclo-[[Abu]-QTWQC]-[Phe[4-(2-aminoethoxy)]]-[Phe(3,4-Cl$_2$)]-[Aib]-ENN-NH$_2$ | *** | | * |
| 954 | Ac-Cyclo-[[Abu]-QTWQC]-[Phe[4-(2-aminoethoxy)]]-[2-Nal]-[α-MeLeu)-[Cit]-NN-NH$_2$ | * | * | * |
| 955 | Ac-Cyclo-[[Abu]-QTWQC]-[Phe[4-(2-aminoethoxy)]]-[2-Nal]-[α-MeLeu]-[Lys(Ac)]-NN-NH$_2$ | * | * | * |
| 956 | Ac-Cyclo-[[Abu]-QTWQC]-[Phe(4-Me)]-[2-Nal]-[Aib]-ENG-NH$_2$ | ** | | * |
| 957 | Ac-Cyclo-[[Abu]-QTWQC]-[Phe(3,4-F$_2$)]-[2-Nal]-[Aib]-ENG-NH$_2$ | *** | | ** |
| 958 | Ac-Cyclo-[[Abu]-QTWQC]-[Phe(3-CONH$_2$)]-[2-Nal]-[Aib]-ENG-NH$_2$ | **** | | |
| 959 | Ac-Cyclo-[[Abu]-QTWQC]-[Phe(2,4-Cl$_2$)]-[2-Nal]-[Aib]-ENG-NH$_2$ | **** | | |
| 960 | Ac-Cyclo-[[Abu]-QTWQC]-[Phe(3-Me)]-[2-Nal]-[Aib]-ENG-NH$_2$ | ** | | * |
| 961 | Ac-Cyclo-[[Abu]-QTWQC]-[Phe(4-Cl)]-[2-Nal]-[Aib]-ENG-NH$_2$ | ** | | * |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH₂

| SEQ ID NO. | Sequence | Human ELISA (nM) | Rat ELISA (nM) | pStat3 HTRF (nM |
|---|---|---|---|---|
| 962 | Ac-Cyclo-[[Abu]-QTWQC]-[Phe(4-F)]-[2-Nal]-[Aib]-ENG-NH₂ | **** | | |
| 963 | Ac-Cyclo-[[Abu]-QTWQC]-[Phe(2,4-Cl₂, 4-OBz)]-[2-Nal]-[Aib]-ENG-NH₂ | ***** | | |
| 964 | Ac-Cyclo-[[Abu]-QTWQC]-[Phe(4-OMe)]-[2-Nal]-[α-MeLeu]-ENG-[(D)Lys]-NH₂ | *** | | ** |
| 965 | Ac-E-Cyclo-[[Abu]-QTWQC]-[Phe[4-(2-aminoethoxy)]]-[2-Nal]-[α-MeLys]-ENN-NH₂ | * | * | * |
| 966 | Ac-(D)Glu-[Cyclo-[[Abu]-QTWQC]-[Phe[4-(2-aminoethoxy)]]-[2-Nal]-[α-MeLys]-ENN-NH₂ | * | * | * |
| 967 | Ac-Arg-Cyclo-[[Abu]-QTWQC]-[Phe[4-(2-aminoethoxy)]]-[2-Nal]-[α-MeLys]-ENN-NH₂ | * | | * |
| 968 | Ac-[(D)Arg]-Cyclo-[[Abu]-QTWQC]-[Phe[4-(2-aminoethoxy)]]-[2-Nal]-[α-MeLys]-ENN-NH₂ | * | * | * |
| 969 | Ac-F-Cyclo-[[Abu]-QTWQC]]-[Phe[4-(2-aminoethoxy)]]-[2-Nal]-[α-MeLys]-ENN-NH₂ | * | * | * |
| 970 | Ac-[(D)Phe]-Cyclo-[[Abu]-QTWQC]-[Phe[4-(2-aminoethoxy)]]-[2-Nal]-[α-MeLys]-ENN-NH₂ | * | * | * |
| 971 | Ac-[2-Nal]-Cyclo-[[Abu]-QTWQC]-[Phe[4-(2-aminoethoxy)]]-[2-Nal]-[α-MeLys]-ENN-NH₂ | * | ** | * |
| 972 | Ac-T-Cyclo-[[Abu]-QTWQC]-[Phe[4-(2-aminoethoxy)]]-[2-Nal]-[α-MeLys]-ENN-NH₂ | * | * | * |
| 973 | Ac-Leu-Cyclo-[[Abu]-QTWQC]-[Phe[4-(2-aminoethoxy)]]-[2-Nal]-[α-MeLys]-ENN-NH₂ | * | * | * |
| 974 | Ac-[(D)Gln]-Cyclo-[[Abu]-QTWQC]-[Phe[4-(2-aminoethoxy)]]-[2-Nal]-[α-MeLys]-ENN-NH₂ | * | * | * |
| 975 | Ac-Cyclo-[[Abu]-QTWQC]-[Phe[4-(2-aminoethoxy)]]-[2-Nal]-[Acpc]-ENN-NH₂ | | | ** |
| 976 | Ac-Cyclo-[[Abu]-QTWQC]-[Phe[4-(2-aminoethoxy)]]-[2-Nal]-[Acbc]-ENN-NH₂ | | * | * |
| 977 | Ac-Cyclo-[[Abu]-QTWQC]-[Phe[4-(2-aminoethoxy)]]-[2-Nal]-[Achc]-ENN-NH₂ | | * | * |
| 978 | Ac-Cyclo-[[Abu]-QTWQC]-[Phe[4-(2-aminoethoxy)]]-[2-Nal]-[Acvc]-ENN-NH₂ | | * | * |
| 979 | Ac-Cyclo-[[Abu]-QTWQC]-[Phe[4-(2-aminoethoxy)]]-[2-Nal]-[4-amino-4-carboxy-piperidine]-ENN-NH₂ | | | * |
| 980 | Ac-Cyclo-[[Abu]-QTWQC]-[Phe[4-(2-aminoethoxy)]]-[2-Nal]-[4-amino-4-carboxy-tetrahydropyran]-ENN-NH₂ | * | * | * |
| 981 | Ac-Cyclo-[[Abu]-QTWQC]-[Phe[4-(2-aminoethoxy)]]-[2-Nal]-[α-MeLeu]-[Lys(Ac)]-NG-NH₂ | | | * |
| 982 | Ac-Cyclo-[[Abu]-QTWQC]-[Phe[4-(2-aminoethoxy)]]-[2-Nal]-[α-MeLeu]-ENG-NH₂ | | | * |
| 983 | Ac-Cyclo-[[Abu]-QTWQC]-[Phe[4-(2-aminoethoxy)]]-[2-Nal]-[α-MeLeu]-QNG-NH₂ | | | * |

TABLE 5B-continued

IC50 of Illustrative Peptide Inhibitors (Thioethers)

Ac-Cyclo-[[Abu]-XXWXC]-[Phe(4-OMe)]-[2-Nal]-XXX-NH$_2$

| SEQ ID NO. | Sequence | Human ELISA (nM) | Rat ELISA (nM) | pStat3 HTRF (nM |
|---|---|---|---|---|
| 984 | Ac-Cyclo-[[Abu]-QTWQC]-[Phe[4-(2-aminoethoxy)]]-[2-Nal]-[α-MeLeu]-QN-[βAla]-NH$_2$ | | | * |
| 985 | Ac-Cyclo-[[Abu]-QTWQC]-[Phe[4-(2-aminoethoxy)]]-[2-Nal]-[α-MeLeu]-QDG-NH$_2$ | | | *** |
| 986 | Ac-Cyclo-[[Abu]-QTWQC]-cyclo([Phe[4-(2-aminoethoxy)]]-[2-Nal]-[α-MeLeu]-QD]-G-NH$_2$ | | | **** |
| 987 | Ac-Cyclo-[[Abu]-QTWQC]-[Phe[4-(2-aminoethoxy)]]-[2-Nal]-[Aib]-QN-[βAla]-NH$_2$ | | | * |
| 988 | Ac-Cyclo-[[Abu]-QTWQC]-[Phe[4-(2-aminoethoxy)]]-[1,2,3,4-tetrahydro-norharman]-[Aib]-QNG-NH$_2$ | | | |
| 989 | Ac-Cyclo-[[Abu]-QTWQC]-[Phe[4-(2-aminoethoxy)]]-[5-hydroxyTrp]-[Aib]-QNG-NH$_2$ | | | ** |
| 990 | Ac-Cyclo-[[Abu]-QTWQC]-[Phe[4-(2-aminoethoxy)]]-[2-Nal]-[α-MeLys]-[Lys(Ac)]-[Asn(isobutyl)]-G-NH$_2$ | | | *** |
| 991 | Ac-Cyclo-[[Abu]-QTWQC]-[Phe[4-(2-aminoethoxy)]]-[2-Nal]-[α-MeLys]-[Lys(Ac)]-[Asp(1,4-diaminoethane)]-G-NH$_2$ | | | *** |
| 992 | Ac-(D)Phe-Cyclo-[[Abu]-QTWQC]-[Phe[4-(2-aminoethoxy)]]-[2-Nal]-[4-amino-4-carboxy-tetrahydropyran]-ENN-NH$_2$ | | | |
| 993 | Ac-[(D)Arg]-Cyclo-[[Abu]-QTWQC]-[Phe[4-(2-aminoethoxy)]]-[2-Nal]-[4-amino-4-carboxy-tetrahydropyran]-ENN-NH$_2$ | | | |

\* = <10 nM;
\*\* = 10-25 nM
\*\*\* = 25-100 nM,
\*\*\*\* = 100-1000 nM,
\*\*\*\*\* = >1000 nM.

TABLE 5C

IC50 of Illustrative Thioether Peptide Dimers Synthesized

| SEQ ID NO. | Linker Moiety | Sequence | Human ELISA (nM) | Rat ELISA (nM) | pStat3 HTRF (nM) |
|---|---|---|---|---|---|
| 994 | DIG through (D)Lys | [Ac-[(D)Lys]-Cyclo-[[Abu]-QTWQC]-[Phe(4-OMe)]-[2-Nal]-[α-MeLeu]-ENG-NH$_2$]$_2$ DIG | * | *** | * |
| 995 | DIG through Phe[4-(2-aminoethoxy)] | [Ac-Cyclo-[[Abu]-QTWQC]-[Phe[4-(2-aminoethoxy)]]-[2-Nal]-[Aib]-QNG-NH$_2$]$_2$ DIG | *** | | ** |
| 996 | DIG through α-MeLys | [Ac-Cyclo-[[Abu]-QTWQC]-[Phe(4-OMe)]-[2-Nal]-[α-MeLys]-ENG-NH2]$_2$ DIG | * | ** | * |

TABLE 5C-continued

IC50 of Illustrative Thioether Peptide Dimers Synthesized

| SEQ ID NO. | Linker Moiety | Sequence | Human ELISA (nM) | Rat ELISA (nM) | pStat3 HTRF (nM) |
|---|---|---|---|---|---|
| 997 | PEG25 through α-MeLys | [Ac-[(D)Lys]-Cyclo-[[Abu]-QTWQC]-[Phe(4-OMe)]-[2-Nal]-[α-MeLys]-ENG-NH2]$_2$ PEG25 | * | ** | * |
| 998 | DIG through (D)Lys | [Ac-Cyclo-[[Abu]-QTWQC]-[Phe(4-OBzl)]-W-[α-MeLys]-ENG-NH$_2$]$_2$ DIG | | | * |
| 999 | PEG25 through (D)Lys | [Ac-Cyclo-[[Abu]-QTWQC]-Y(Bzl)-W-[α-MeLys]-ENG-NH$_2$]$_2$ PEG25 | | | * |

\* = <10 nM;
\*\* = 10-25 nM
\*\*\* = 25-100 nM,
\*\*\*\* = 100-1000 nM,
\*\*\*\*\* = >1000 nM

TABLE 6

IC50 of Peptide Inhibitors (Ring Closing Metathesis)

| SEQ ID NO. | Sequence/Structure | Human ELISA (nM) |
|---|---|---|
| 1000 | NH$_2$-[cycle]-ADWV-NH-[cycle]-YWHTFG-NH$_2$ | ~20000 |
| 1001 | Ac-NH-[cycle]-ADWV-NH-[cycle]-YWHTFG-NH$_2$ | ~30000 |
| 1002 | Ac-NH-[cycle(2,3)]-RTWQ-NH-[cycle]-YWRKFG-[AEA]-[(D)Lys]-NH$_2$ | ***** |
| 1003 | Ac-NH-[cycle(3,2)]-RTWQ-NH-[cycle]-YWRKFG-[AEA]-[(D)Lys]-NH$_2$ | ***** |
| 1004 | Ac-NH-[cycle(,3)]-RTWQ-NH-[cycle]-YWRKFG-[AEA]-[(D)Lys]-NH$_2$ | ***** |

TABLE 6-continued

IC50 of Peptide Inhibitors (Ring Closing Metathesis)

| SEQ ID NO. | Sequence/Structure | Human ELISA (nM) |
|---|---|---|
| 1005 | 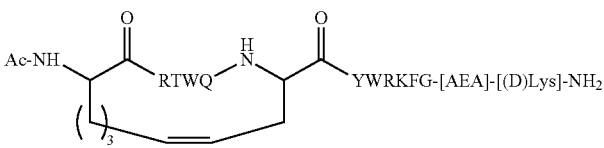 Ac-NH-(...)₃-RTWQ-NH-...-YWRKFG-[AEA]-[(D)Lys]-NH₂ | **** |
| 1006 | 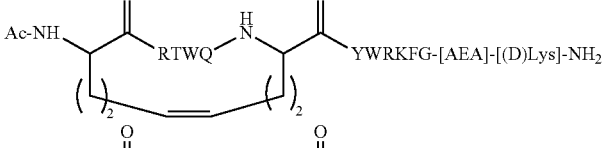 Ac-NH-(...)₂-RTWQ-NH-(...)₂-YWRKFG-[AEA]-[(D)Lys]-NH₂ | **** |
| 1007 | 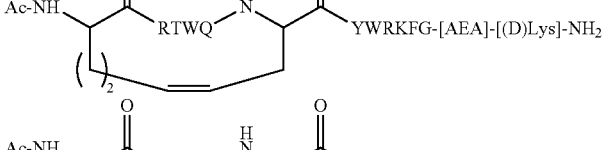 Ac-NH-(...)₂-RTWQ-NH-...-YWRKFG-[AEA]-[(D)Lys]-NH₂ | **** |
| 1008 | 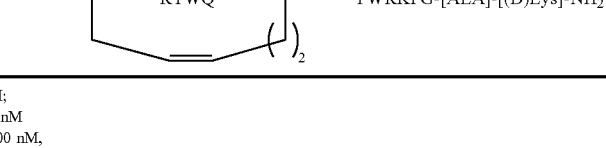 Ac-NH-...-RTWQ-NH-(...)₂-YWRKFG-[AEA]-[(D)Lys]-NH₂ | **** |

\* = <10 nM;
\*\* = 10-25 nM
\*\*\* = 25-100 nM,
\*\*\*\* = 100-1000 nM,
\*\*\*\*\* = 1000-10,000 nM.

TABLE 7

IC50 of Illustrative Peptides Containing Cyclic amides (side chain cyclizations)

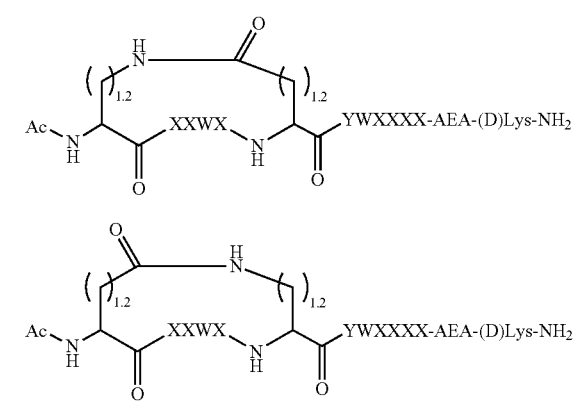

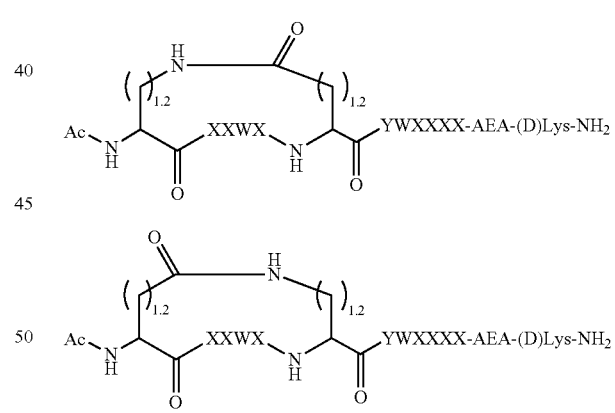

| SEQ ID NO. | Sequence | Human ELISA (nM) |
|---|---|---|
| 1009 | Ac-Cyclo-[[Dap]-QTWQE]-YWRENG-[AEA]-[(D)Lys]-NH₂ | ~6000 |
| 1010 | Ac-Cyclo-[EQTWQ-[Dab]]-YWRENG-[AEA]-[(D)Lys]-NH₂ | >6000 |
| 1011 | Ac-Cyclo-[EQTWQ-[Dap]]-YWRENG-[AEA]-[(D)Lys]-NH₂ | ~6000 |
| 1012 | Ac-Cyclo-[[Dab]QTWQE]-YWRENG-[AEA]-[(D)Lys]-NH₂ | ~30000 |
| 1013 | Ac-Cyclo-[[Dap]-QTWQ-[(D)Asp]]-YWRENG-[AEA]-[(D)Lys]-NH₂ | >30000 |
| 1014 | Ac-Cyclo-[[Dap]-QTWQD]-YWRENG-[AEA]-[(D)Lys]-NH₂ | >30000 |
| 1015 | Ac-Cyclo-[[DQTWQ-[Dab]]-YWRENG-[AEA]-[(D)Lys]-NH₂ | ~6000 |
| 1016 | Ac-Cyclo-[[Dab]QTWQD]-YWRENG-[AEA]-[(D)Lys]-NH₂ | >6000 |
| 1017 | Ac-Cyclo-[[(D)Dab]-QTWQ-[(D)Asp]]-YWRENG-[AEA]-[(D)Lys]-NH₂ | ~6000 |
| 1018 | Ac-Cyclo-[[(D)Asp]-QTWQ-[(D)Dab]]-YWRENG-[AEA]-[(D)Lys]-NH₂ | ~1400 |
| 1019 | Ac-Cyclo-[[(D)Asp]-QTWQ-[(D)Dap]]-YWRENG-[AEA]-[(D)Lys]-NH₂ | ~30000 |

TABLE 8

IC50 of Illustrative Peptides Containing the Ac-[Pen]-XXWXXXXXX Motif and Ac-XXXWX-[Pen]-XXXX analogues

| SEQ ID NO. | Sequence | Human ELISA (nM) | Rat ELISA (nM) | pStat3 HTRF (nM) |
|---|---|---|---|---|
| 1020 | Ac-[Pen]-ADWVCYWHTFG-NH₂ | ***** | | |
| 1021 | Ac-CADWV-[Pen]-YWHTFG-NH₂ | ***** | | |
| 1022 | Ac-[(D)Pen]-ADWVCYWHTFG-[AEA]-[(D)-Lys]-NH₂ | **** | ***** | **** |
| 1023 | Ac-CADWV-[(D)Pen]-YWHTFG-[AEA]-[(D)-Lys]-NH₂ | >30000 | ***** | **** |
| 1024 | Ac-[Pen]-RTWQCYWRKFG-[AEA]-[(D)-Lys]-NH₂ | **** | **** | **** |
| 1025 | Ac-ACDWV-[Pen]-YWRKFG-[AEA]-[(D)-Lys]-NH₂ | ***** | | |
| 1026 | Ac-A-[Pen]-DWVCYWRKFG-[AEA]-[(D)-Lys]-NH₂ | **** | | |
| 1027 | Ac-A-[hCys]-DWV-[Pen]-YWRKFG-[AEA]-[(D)-Lys]-NH₂ | ~30000 | | |
| 1028 | Ac-CQTWQ-[Pen]-YW-[α-MeLeu]-ENG-NH₂ | **** | **** | |
| 1029 | Ac-CQTWQ-[Pen]-YW-[(D)Asn]-ENG-NH₂ | ***** | | |

\* = <10 nM;
\*\* = 10-25 nM
\*\*\* = 25-100 nM,
\*\*\*\* = 100-1000 nM,
\*\*\*\*\* = 1000-10,000 nM.

SAR analysis of the activities of the peptide inhibitors tested indicated that the CXXXXC disulphide is associated with high activity. The two Trp residues and the Phe residue are also associated with high activity, but it is recognized that these amino acids can be readily exchanged with similar homologs (e.g., 1-Nal substituted for Trp and/or Phe substituted for Tyr). In addition, the data suggested that the presence of one or more basic residues at the C-terminus is associated with high activity. Also, His-9 can be replaced by Arg or another homolog and maintain or improve activity. The schematic below provides one illustrative consensus sequence (SEQ ID NO: 275) showing certain residues associated with high activity.

```
 1   2   3   4   5   6   7   8   9  10  11  12  13   14
Cys-Xxx-Xxx-Trp-Xxx-Cys-Tyr-Trp-His-Xxx-Phe-Xxx-Xxx-(D)Lys-OH
```

Example 3

Stability of Peptide Inhibitors in Simulated Intestinal Fluid (SIF), Simulated Gastric Fluid (SGF) and Redox Conditions Studies were carried out in simulated intestinal fluid (SIF) and simulated gastric fluid (SGF) to evaluate gastric stability of the peptide inhibitors of the present invention. In addition, studies were carried out to assess redox stability of the peptide inhibitors of the present invention.

SIF was prepared by adding 6.8 g of monobasic potassium phosphate and 10.0 g of pancreatin to 1.0 L of water. After dissolution, the pH was adjusted to 6.8 using NaOH. DMSO stocks (2 mM) were first prepared for the test compounds. Aliquots of the DMSO solutions were dosed into 6 individual tubes, each containing 0.5 mL of SIF, which is pre-warmed to 37° C. The final test compound concentration was 20 μM. The vials were kept in a benchtop Thermomixer® for the duration of the experiment. At each timepoint (0, 5, 10, 20, 40, 60, or 360 minutes or 24 hours), 1.0 mL of acetonitrile containing 1% formic acid was added to one vial to terminate the reaction. Samples were stored at 4° C. until the end of the experiment. After the final timepoint is sampled, the tubes were mixed and then centrifuged at 3,000 rpm for 10 minutes. Aliquots of the supernatant were removed, diluted 1:1 into distilled water containing internal standard, and analyzed by LCMS/MS. Percent remaining at each timepoint was calculated based on the peak area response ratio of test to compound to internal standard. Time 0 was set to 100%, and all later timepoints were calculated relative to time 0. Half-lives were calculated by fitting to a first-order exponential decay equation using Graphpad. Stability in SIF assays is shown in Tables 9 and 10.

SGF was prepared by adding 20 mg NaCl, 32 mg porcine pepsin (MP Biochemicals, catalog 02102599), and 70 μl HCl to 10 ml water (final pH=2). Aliquots of SGF (0.5 ml each) were pre-warmed at 37° C. To start the reaction, 1 μl of peptide stock solution (10 mM in DMSO) was added to 0.5 ml SGF and thoroughly mixed such that the final peptide concentration was 20 μM. The reactions were incubated at 37° C. with gentle shaking. At each time point (0, 15, 30, 60 min) 50 μl aliquots were removed and added to 200 ul acetonitrile containing 0.1% formic acid to quench the reaction. Samples are stored at 4° C. until the end of the experiment and centrifuged at 10,000 rpm for 5 minutes. Aliquots of the supernatant were removed, diluted 1:1 into distilled water containing internal standard, and analyzed by LCMS/MS. Percent remaining at each timepoint was calculated based on the peak area response ratio of test to compound to internal standard. Time 0 was set to 100%, and all later timepoints were calculated relative to time 0. Half-lives were calculated by fitting to a first-order exponential decay equation using GraphPad. Stability in SGF assays in shown in Tables 9 and 10.

TABLE 9

Stability of Illustrative Peptides containing the Ac-[Pen]-XXWX-[Pen]-XXXX Motif and Analogues in Simulated Intestinal Fluid (SIF) and Simulated Gastric Fluid (SGF)

| SEQ ID NO: | Sequence | SGF $t^1/_2$ (min) | SIF $t^1/_2$ (min) |
|---|---|---|---|
| 549 | Ac-[Pen]-QTWQ-[Pen]-YW-[hLeu]-ENG-NH$_2$ | | *****§ |
| 1030 | Ac-[Pen]-QTWQ-[Pen]-YWN-Me-RENG-NH$_2$ | | ****§ |
| 551 | Ac-[Pen]-QTWQ-[Pen]-YW-[hLeu]-ENG-NH$_2$ | | *****§ |
| 552 | Ac-[Pen]-QTWQ-[Pen]-YW-[N-MeArg]-ENG-NH$_2$ | | *** |
| 554 | Ac-[Pen]-QTWQ-[Pen]-YW-[α-MeLeu]-ENG-NH$_2$ | | ** |
| 1028 | Ac-CQTWQ-[Pen]-YW-[α-MeLen]-ENG-NH$_2$ | | ***** |
| 555 | Ac-[Pen]-QTWQ-[Pen]-YW-[(D)Asn]-ENG-NH$_2$ | | ** |
| 1029 | Ac-CQTWQ-[Pen]-YW-[(D)Asn]-ENG-NH$_2$ | | ***** |
| 556 | Ac-[Pen]-QTWQ-[Pen]-Y-[2-Nal]-[α-MeLys]-ENG-NH$_2$ | | ** |
| 557 | Ac-[Pen]-QTWQ-[Pen]-[Phe(4-OMe)]-[2-Nal]-[α-MeLys]-ENG-NH$_2$ | *** | ** |
| 558 | Ac-[Pen]-QTWQ-[Pen]-[2-Nal]-[2-Nal]-[α-MeLys]-ENG-NH$_2$ | | ** |
| 559 | Ac-[Pen]-QTWQ-[Pen]-Y-[2-Nal]-[α-MeOrn]-ENG-NH$_2$ | | ** |
| 560 | Ac-[Pen]-QTWQ-[Pen]-YW-[α-MeOrn]-ENG-NH$_2$ | | ** |
| 561 | Ac-[Pen]-QTWQ-[Pen]-Y-[1-Nal]-[α-MeOrn]-ENG-NH$_2$ | | ** |
| 1031 | Ac-[Pen]-QTWQ-[Pen]-[[Phe(4-OMe)](OMe)]-[2-Nal]-[α-MeOrn]-[Lys(Ac)]-NG-NH$_2$ | | * |
| 563 | Ac-[Pen]-QTWQ-[Pen]-YW-[α-MeLys]-[Lys(Ac)]-NG-NH$_2$ | * | * |
| 1032 | Ac-[Pen]-QTWQ-[Pen]-[Phe(4-OMe)]-W-[α-MeLys]-[Lys(Ac)]-NG-NH$_2$ | | * |
| 565 | Ac-[Pen]-QTWQ-[Pen]-[Phe(4-OMe)]-[2-Nal]-[α-MeLys]-[Lys(Ac)]-NG-NH$_2$ | * | * |
| 566 | Ac-[Pen]-QTWQ-[Pen]-[Phe(4-OMe)]-[1-Nal]-[α-MeLys]-[Lys(Ac)]-NG-NH$_2$ | | * |
| 1033 | succinicanhydride-[Pen]-QTWQ[Pen]-[Phe(4-OMe)]-[2-Nal]-[α-MeLys]-[Lys(Ac)]-NG-NH$_2$ | ** | * |
| 585 | pyroglutamicacid-[Pen]-QTWQ[Pen]-[Phe(4-OMe)]-[2-Nal]-[α-MeLys]-[Lys(Ac)]-NG-NH$_2$ | ** | * |

TABLE 9-continued

Stability of Illustrative Peptides containing the Ac-[Pen]-XXWX-[Pen]-XXXX Motif
and Analogues in Simulated Intestinal Fluid (SIF) and Simulated Gastric Fluid (SGF)

| SEQ ID NO: | Sequence | SGF t½ (min) | SIF t½ (min) |
|---|---|---|---|
| 1034 | Ac-[Pen]-QTWQ-[Pen]-[Phe[4-(2-aminoethoxy)]-[2-Nal]-[α-MeLys]-[Lys(Ac)]-NN-NH$_2$ | * | * |
| 601 | Ac-[Pen]-QTWQ-[Pen]-[Phe[4-(2-aminoethoxy)]-[2-Nal]-[α-MeLys]-ENA-NH$_2$ | * | * |
| 602 | Ac-[Pen]-QTWQ-[Pen]-[Phe[4-(2-aminoethoxy)]-[2-Nal]-[α-MeLeu]-[Lys(Ac)]-NN-NH$_2$ | ** | *** |
| 603 | Ac-[Pen]-QTWQ-[Pen]-[Phe[4-(2-aminoethoxy)]-[2-Nal]-[α-MeLeu]-QNN-NH$_2$ | * | * |
| 604 | Ac-[Pen]-QTWQ-[Pen]-[Phe[4-(2-aminoethoxy)]-[2-Nal]-[Aib]-ENN-NH$_2$ | * | * |
| 605 | Ac-[Pen]-QTWQ-[Pen]-[Phe[4-(2-aminoethoxy)]-[2-Nal]-Aib-[Lys(Ac)]-NN-NH$_2$ | ** | *** |
| 606 | Ac-[Pen]-QTWQ-[Pen]-[Phe[4-(2-aminoethoxy)]-[2-Nal]-[Aib]-[Lys(Ac)]-NQ-NH$_2$ | * | * |
| 607 | Ac-[Pen]-Dap(Ac)TWQ-[Pen]-[Phe[4-(2-acetylaminoethoxy)]-[2-Nal]-[α-MeLys(Ac)]-ENG-NH$_2$ | * | * |
| 608 | Ac-[Pen]-[α-MeOrn(Ac)]-TWQ-[Pen]-[Phe[4-(2-acetylaminoethoxy)]-[2-Nal]-[α-MeLys(Ac)]-ENG-NH$_2$ | ** | **** |
| 609 | Ac-[Pen]-QTWQ-[Pen]-[Phe[4-(2-acetylaminoethoxy)]-[2-Nal]-[α-MeLys(Ac)]-[Lys(Ac)]-NG-NH$_2$ | * | * |
| 610 | Ac-[Pen]-QTWQ-[Pen]-[Phe[4-(2-acetylaminoethoxy)]-[2-Nal]-[α-MeLys(Ac)]-[Lys(Ac)]-NN-NH$_2$ | * | * |
| 611 | Ac-[Pen]-QTWQ-[Pen]-[Phe[4-(2-acetylaminoethoxy)]-[2-Nal]-[α-MeLys(Ac)]-ENG-NH$_2$ | * | ** |
| 612 | Ac-[Pen]-QTWQ-[Pen]-[Phe[4-(2-acetylaminoethoxy)]-[2-Nal]-[α-MeLys(Ac)]-ENA-NH$_2$ | * | * |
| 613 | Ac-[Pen]-QTWQ-[Pen]-[Phe[4-(2-acetylaminoethoxy)]-[2-Nal]-[α-MeLeu]-[Lys(Ac)]-NN-NH$_2$ | * | * |
| 614 | Ac-[Pen]-QTWQ-[Pen]-[Phe[4-(2-acetylaminoethoxy)]-[2-Nal]-[α-MeLeu]-QNN-NH$_2$ | * | * |
| 615 | Ac-[Pen]-QTWQ-[Pen]-[Phe[4-(2-acetylaminoethoxy)]-[2-Nal]-[Aib]-ENN-NH$_2$ | * | * |
| 616 | Ac-[Pen]-QTWQ-[Pen]-[Phe[4-(2-acetylaminoethoxy)]-[2-Nal]-[Aib]-[Lys(Ac)]-NN-NH$_2$ | * | * |
| 617 | Ac-[Pen]-QTWQ-[Pen]-[Phe[4-(2-acetylaminoethoxy)]-[2-Nal]-[Aib]-[Lys(Ac)]-NQ-NH$_2$ | * | * |
| 522 | [Ac-[Pen]-QTWQ-[Pen]-[Phe(4-OMe)]-[2-Nal]-[α-MeLys]-ENG-NH$_2$]$_2$ DIG | **** | * |
| 618 | Ac-[Pen]-QTWQ-[Pen]-[Phe(4-OMe)]-[2-Nal]-[Aib]-ENN-NH$_2$ | * | *** |
| 619 | Ac-[Pen]-QTWQ-[Pen]-[Phe[4-(2-aminoethoxy)]-[2-Nal]-[hLeu]-ENA-NH$_2$ | ***** | ***** |
| 620 | Ac-[Pen]-TTWQ-[Pen]-[Phe[4-(2-aminoethoxy)]-[2-Nal]-[Aib]-[Lys(Ac)]-NN-NH$_2$ | * | * |
| 625 | Ac-[Pen]-QTWQ-[Pen]-[Phe(4-OMe)]-[2-Nal]-[Aib]-[Lys(Ac)]-NN-NH$_2$ | * | ** |

TABLE 9-continued

Stability of Illustrative Peptides containing the Ac-[Pen]-XXWX-[Pen]-XXXX Motif and Analogues in Simulated Intestinal Fluid (SIF) and Simulated Gastric Fluid (SGF)

| SEQ ID NO: | Sequence | SGF t½ (min) | SIF t½ (min) |
|---|---|---|---|
| 628 | Ac-[Pen]-QTWQ-[Pen]-[Phe[4-(2-aminoethoxy)]-[2-Nal]-[Aib]-[Lys(Ac)]-N-[βAla]-NH₂ | * | * |
| 630 | Ac-[Pen]-NTWQ-[Pen]-[Phe(4-OMe)]-[2-Nal]-[Aib]-ENN-NH₂ | * | *** |
| 631 | Ac-[Pen]-NTWQ-[Pen]-[Phe[4-(2-aminoethoxy)]-[2-Nal]-[hLeu]-ENA-NH₂ | ***** | **** |
| 632 | Ac-[Pen]-NTWQ-[Pen]-[Phe[4-(2-aminoethoxy)]-[2-Nal]-[Aib]-[Lys(Ac)]-NN-NH₂ | * | * |
| 633 | Ac-[Pen]-NTWQ-[Pen]-[Phe(4-OMe)]-[2-Nal]-[Aib]-[Lys(Ac)]-N-[βAla]-NH₂ | * | ** |
| 634 | Ac-[Pen]-NTWQ-[Pen]-[Phe[4-(2-aminoethoxy)]-[2-Nal]-[Aib]-[Lys(Ac)]-NQ-NH₂ | * | * |
| 636 | Ac-[Pen]-NTWQ-[Pen]-[Phe[4-(2-aminoethoxy)]-[2-Nal]-[Aib]-[Lys(Ac)]-NA-NH₂ | * | * |
| 637 | Ac-[Pen]-NTWQ-[Pen]-[Phe(4-OMe)]-[2-Nal]-[Aib]-[Lys(Ac)]-NN-NH₂ | * | * |
| 638 | Ac-[Pen]-NTWQ-[Pen]-[Phe(4-OMe)]-[2-Nal]-[Aib]-[Lys(Ac)]-NQ-NH₂ | * | * |
| 639 | Ac-[Pen]-NTWQ-[Pen]-[Phe[4-(2-aminoethoxy)]-[2-Nal]-[Aib]-[Lys(Ac)]-N-[βAla]-NH₂ | * | * |
| 640 | Ac-[Pen]-NTWQ-[Pen]-[Phe(4-OMe)]-[2-Nal]-[hLeu]-[Lys(Ac)]-N-[βAla]-NH₂ | ***** | ***** |
| 641 | Ac-[Pen]-NTWQ-[Pen]-[Phe[4-(2-aminoethoxy)]-[2-Nal]-[hLeu]-[Lys(Ac)]-N-[βAla]-NH₂ | ***** | ***** |
| 669 | Ac-[Pen]-QTWQ-[Pen]-[Phe(4-CONH₂)]-[2-Nal]-[α-MeVal]-[LYs(Ac)]-NN-NH₂ | ** | * |
| 534 | [Ac-[Pen]-QTWQ-[Pen]-[Phe(4-CONH₂)]-[2-Nan-[α-MeLys]-[Lys(Ac)]-NN-NH₂]₂ DIG | ** | * |
| 1035 | Ac-[(D)Phe]-[Pen]-NTWQ-[Pen]-[Phe[4-(2-aminoethoxy)]-[2-Nal]-[Aib]-[Lys(Ac)]-NN-NH₂ | * | * |
| 676 | Ac-[(D)Phe]-[Pen]-NTWQ-[Pen]-[Phe[4-(2-aminoethoxy)]-[2-Nal]-[Aib]-[Lys(Ac)]-N-[βAla]-NH₂ | ** | * |
| 682 | Ac-[Pen]-NTWQ[Pen]-[Phe(4-CONH₂)]-[2-Nal]-[Aib]-[Lys(Ac)]-NN-NH₂ | ** | **** |
| 683 | Ac-[Pen]-NTWQ[Pen]-[Phe(4-CONH₂)]-[2-Nal]-[4-amino-4-carboxy-tetrahydropyran-Lys(Ac)]-NN-NH₂ | ** | * |
| 684 | Ac-[Pen]-NTWQ[Pen]-[Phe(4-CONH₂)]-[2-Nal]-[Achc]-[Lys(Ac)]-NN-NH₂ | * | * |
| 1036 | Ac-[Pen]-NTWQ[Pen]-[Phe(4-CONH₂)]-[2-Nal]-[Acvc]-[Lys(Ac)]-NN-NH₂ | * | * |
| 686 | Ac-[Pen]-NTWQ[Pen]-[Phe(4-CONH₂)]-[2-Nal]-[αa-MeLeul-[LYs(Ac)]-NN-NH₂ | * | * |
| 688 | Ac-[Pen]-NTWQ[Pen]-[Phe(4-OMe)]-[2-Nal]-[4-amino-4-carboxy-tetrahydropyran-[Lys(Ac)]-NN-NH₂ | * | * |
| 689 | Ac-[Pen]-NTWQ[Pen]-[Phe(4-OMe)]-[2-Nal]-[Achc]-[Lys(Ac)]-NN-NH₂ | * | ** |
| 1037 | Ac-[Pen]-NTWQ[Pen]-[Phe(4-OMe)]-[2-Nal]-[Acyc]-[Lys(Ac)]-NN-NH₂ | ** | * |
| 731 | Ac-[Pen]-NTWQ[Pen]-[Phe(4-OMe)]-[2-Nal]-[α-MeLeul-[Lys(Ac)]-NN-NH₂ | * | * |
| 535 | [Ac-[Pen]-NTWQ-[Pen]-[Phe(4-CONH₂)]-[2-Nal]-[Aib]-KNN-NH₂]₂ DIG | ** | ** |

TABLE 9-continued

Stability of Illustrative Peptides containing the Ac-[Pen]-XXWX-[Pen]-XXXX Motif and Analogues in Simulated Intestinal Fluid (SIF) and Simulated Gastric Fluid (SGF)

| SEQ ID NO: | Sequence | SGF $t^{1}/_{2}$ (min) | SIF $t^{1}/_{2}$ (min) |
|---|---|---|---|
| 536 | [Ac-[Pen]-NTWQ-[Pen]-[Phe(4-CONH$_2$)]-[2-Nal]-[4-amino-4-carboxy-tetrahydropyran]-KNN-NH$_2$)$_2$ DIG | * | * |
| 537 | [Ac-[Pen]-NTWQ-[Pen]-[Phe(4-CONH$_2$)]-[2-Nal]-[Achc]-KNN-NH$_2$)$_2$ DIG | ** | *** |
| 539 | [Ac-[Pen]-NTWQ-[Pen]-[Phe(4-CONH$_2$)]-[2-Nal]-[α-MeLeu]-KNN-NH$_2$)$_2$ DIG | ** | ** |

§the matrix used is 100 fold dilution of standard SIF concentration
* = >360 min;
** = 180-360 minn;
*** = 120-180 min;
**** = <60-120 min;
***** = <60 min

TABLE 10

Stability of Illustrative Peptides Containing Thioethers Motif and Analogues Within Simulated Intestinal Fluid (SIF) and Simulated Gastric Fluid (SGF)

| SEQ ID NO: | Sequence | SIF $t^{1}/_{2}$ (min) | SGF $t^{1}/_{2}$ (min) |
|---|---|---|---|
| 692 | Ac-Cyclo-[[Abu]RTWQC]-YWRKFG-[AEA]-[(D)Lys]-NH$_2$ | ***** | |
| 694 | Ac-Cyclo-[[Abu]-QTWQC]-YWRENG-[AEA]-[(D)Lys]-NH$_2$ | ***** | |
| 699 | Ac-Cyclo-[[Abu]-QTWQC]-YW-[hLeu]-ENG-NH$_2$ | ***** | ND |
| 700 | Ac-Cyclo-[Abu]-QTWQ-(D)Cys]]-YW-[hLeu]-ENG-NH$_2$ | ****§ | |
| 701 | Ac-Cyclo-[[Abu]-QTWQ-[Pen]]-YW-[hLeu]-ENG-NH$_2$ | ***** | |
| 703 | Ac-Cyclo-[[Abu]-QTWQC-YW-[α-MeLeu]-ENG-NH$_2$ | ***** | |
| 704 | Ac-Cyclo-[[Abu]-QTWQC-Y-[2-Nal]-[α-MeLys]-ENG-NH$_2$ | ***** | |
| 702 | Ac-Cyclo-[[Abu]-QTWQC]-[Phe(4-OMe)]-[2-Nal]-[α-MeLys]-ENG-NH$_2$ | *** | ***** |
| 706 | Ac-Cyclo-[[Abta]-QTWQC]-[Phe(4-OMe)]-[2-Nal]-[α-MeOrn]-ENG-NH$_2$ | *** | ***** |
| 707 | Ac-Cyclo-[[Abu]-QTWQC]-[Phe(4-OMe)]-W-[α-MeOrn]-ENG-NH$_2$ | ** | ***** |
| 702 | Ac-Cyclo-[[Abu]-QTWQC]-[Phe(4-OMe)]-[2-Nal]-[α-MeLys]-ENG-NH$_2$ | ** | ***** |
| 709 | Ac-Cyclo-[[Abu]-QTWQC]-[Phe(4-OMe)]-W-[α-MeLys]-[Lys(Ac)]-NG-NH$_2$ | * | ***** |
| 710 | Ac-Cyclo-[[Abu]-QTWQC]-[Phe(4-OMe)]-W-[α-MeLys]-ENG-NH$_2$ | * | ***** |
| 711 | Ac-Cyclo-[[Abu]-QTWQC]-[Phe(4-OMe)]-[1-Nal]α-MeLys]-[Lys(Ac)]-NG-NH$_2$ | * | ***** |
| 712 | Ac-Cyclo-[[Abu]-QTWQC]-[Phe(4-OMe)]-[2-Nal]-[α-MeLys]-[Lys(Ac)]-NG-NH$_2$ | ** | ***** |
| 713 | Ac-Cyclo-[[Abu]-QTWQC]-YW-[α-MeOrn]-[Lys(Ac)]-NG-NH$_2$ | ** | |
| 714 | Ac-Cyclo-[[Abu]-QTWQC]-[Phe(4-OMe)]-[2-Nal]-[(D)Asn]-[Lys(Ac)]-NG-NH$_2$ | * | |
| 715 | Ac-Cyclo-[[Abu]-QTWQC]-[Phe(4-Phenoxy)]-[2-Nal]-[α-MeLys]-[Lys(Ac)]-NG-NH$_2$ | * | |

TABLE 10-continued

Stability of Illustrative Peptides Containing Thioethers Motif and Analogues Within Simulated Intestinal Fluid (SIF) and Simulated Gastric Fluid (SGF)

| SEQ ID NO: | Sequence | SIF t½ (min) | SGF t½ (min) |
|---|---|---|---|
| 716 | Ac-Cyclo-[[Abu]-QTWQC]-[hPhe(3,4-dimethoxy)]-[2-Nal]-[α-MeLys]-[Lys(Ac)]-NG-NH$_2$ | ** | |
| 717 | Ac-Cyclo-[[Abu]-QTWQC]-[DMT]-[2-Nal]-[α-MeLys]-[Lys(Ac)]-NG-NH$_2$ | * | |
| 718 | Ac-Cyclo-[[Abu]-QTWQC]-[Phe(4-CONH$_2$)]-[2-Nal]-[α-MeLys]-[Lys(Ac)]NG-NH$_2$ | *** | ***** |
| 719 | Ac-Cyclo-[[Abu]-QTWQQ-Phe(3,4-Cl$_2$)[2-Nal]-[α-MeLys]-[Lys(Ac)]NG-NH$_2$ | *** | |
| 720 | Ac-Cyclo-[[Abu]-QTWQ-[Pen]]-[Phe(4-OMe)]-[2-Nal]-[α-MeLys]-ENG-NH$_2$ | ** | *** |
| 721 | Ac-Cyclo-[[Abu]-QTWQ-[Pen]]-[Phe(4-OMe)]-[2-Nal]-[α-MeLys]-[Lys(Ac)]NG-NH$_2$ | ** | *** |
| 782 | Ac-Cyclo-[[Abu]-QTWQC]-[Phe[4-(2-aminoethoxy)]]-W-[α-MeLys]-ENG-NH$_2$ | * | *** |
| 790 | Ac-Cyclo-[[Abu]-QTWQC]-[Phe(4-OMe)]-[2-Nal]-[α-MeOrn]-[Lys(Ac)]-NG-NH$_2$ | *** | ***** |
| 791 | Ac-Cyclo-[[Abu]-QTWQC]-[2-Nal]-[2-Nal]-[α-MeOrn]-[Lys(Ac)]-NG-NH$_2$ | *** | ND |
| 794 | Ac-Cyclo-[[Abu]-QTWQC]-[2-Nal]-[2-Nal]-[α-MeLys]-[Lys(Ac)]-NG-NH$_2$ | ** | ND |
| 797 | Ac-Cyclo-[[Abu]-QTWQC]-[Phe(4-CONH$_2$)]-[2-Nal]-[α-MeLys]-[Lys(Ac)]-NG-NH$_2$ | **** | ***** |
| 798 | Ac-Cyclo-[[Abu]-QTWQC]-[2-Nal]-[2-Nal]-[α-MeLys]-ENG-NH$_2$ | ** | ND |
| 810 | Ac-Cyclo-[[Abu]-QTWQC]-[Phe(4-OMe)]-[2-Nal]-[Aib]-[Lys(Ac)]-NG-NH$_2$ | * | |
| 815 | Ac-Cyclo-[[Abu]-QTWQC]-[Phe(4-OMe)]-[2-Nal]-[Orn]-[Lys(Ac)]-NG-NH$_2$ | * | |
| 820 | Ac-Cyclo-[[Abu]-QTWQC]-[Phe(4-OMe]-[2-Nal]-[Chg]-[Lys(Ac)]-NG-NH$_2$ | *** | |
| 822 | Ac-Cyclo-[[Abu]-QTWQC]-[Octgly]-[2-Nal]-[α-MeLys]-[Lys(Ac)]-NG-NH$_2$ | ***** | |
| 823 | Ac-Cyclo-[[Abu]-QTWQC]-[Phe(4-OMe)]-[Octgly]-[α-MeLys]-[Lys(Ac)]-NG-NH$_2$ | **** | |
| 823 | Ac-Cyclo-[[Abu]-QTWQC]-[Phe(4-OMe)]-[Octgly]-[α-MeLys]-[Lys(Ac)]-NG-NH$_2$ | ***** | |
| 829 | Ac-Cyclo-[[Abu]-QTWQC]-[Phe[4-(2-aminoethoxy)]]-[2-Nal]-[α-MeLys]-ENG-NH$_2$ | * | * |
| 857 | Ac-Cyclo-[[Abu]-QTWQC]-[Phe[4-(2-aminoethoxy)]]-[2-Nal]-[α-MeLys]-[Lys(Benzoic acid)]-NG-NH$_2$ | ** | * |
| 861 | Ac-Cyclo-[[Abu]-QTWQC]-[Phe[4-(2-aminoethoxy)]]-[2-Nal]-[α-MeLys]-[Lys(isovaleric acid)]-NG-NH$_2$ | * | * |
| 876 | Ac-Cyclo-[[Abu]-QTWQC]-[Phe[4-(2-aminoethoxy)]]-[2-Nal]-[Aib]-[Lys(Ac)]-QG-NH$_2$ | *** | ***** |
| 877 | Ac-Cyclo-[[Abu]-QTWQC]-[Phe[4-(2-aminoethoxy)]]-[2-Nal]-[Aib]-QNG-NH$_2$ | *** | ** |
| 878 | Ac-Cyclo-[[Abu]-QTWQC]-[Phe[4-(2-aminoethoxy)]]-[2-Nal]-[Aib]-ENG-NH$_2$ | ***** | *** |

TABLE 10-continued

Stability of Illustrative Peptides Containing Thioethers Motif and Analogues Within Simulated Intestinal Fluid (SIF) and Simulated Gastric Fluid (SGF)

| SEQ ID NO: | Sequence | SIF t½ (min) | SGF t½ (min) |
|---|---|---|---|
| 879 | Ac-Cyclo-[[Abu]-QTWQC]-[Phe[4-(2-aminoethoxy)]]-1-Nal[Aib]-[Lys(Ac)]-NG-NH₂ | * | * |
| 880 | Ac-Cyclo-[[Abu]-QTWQC]-[Phe[4-(2-aminoethoxy)]]-[2-Nal]-[Aib]-[Lys(Ac)]-NA-NH₂ | **** | ***** |
| 891 | Ac-Cyclo-[[Abu]-QTWQC]-[Phe[4-(2-aminoethoxy)]]-[2-Nal]-[α-Me-Orn]-[Lys(Ac)]-NG-NH₂ | ** | ** |
| 892 | Ac-Cyclo-[[Abu]-QTWQC]-[Phe[4-(2-aminoethoxy)]]-[2-Nal]-[α-MeLys]-[Lys(Ac)]-NG-NH₂ | * | * |
| 893 | Ac-Cyclo-[[Abu]-QTWQC]-[Phe[4-(2-aminoethoxy)]]-[2-Nal]-[Orn]-[Lys(Ac)]-NG-NH₂ | ***** | |
| 894 | Ac-Cyclo-[[Abu]-QTWQC]-[Phe[4-(2-aminoethoxy)]]-W-[Orn]-ENG-NH₂ | ***** | |
| 895 | Ac-Cyclo-[[Abu]-QTWQC]-[Phe[4-(2-aminoethoxy)]]-W-[Orn]-[Dap]-NG-NH₂ | ***** | |
| 896 | Ac-Cyclo-[[Abu]-QTWQC]-[Phe[4-(2-aminoethoxy)]]-W-[Orn]-[Dap(Ac)]-NG-NH₂ | ***** | |
| 897 | Ac-Cyclo-[[Abu]-QTWQC]-[Phe[4-(2-aminoethoxy)]]-[2-Nal]-[Orn]-[Dap]-NG-NH₂ | ***** | |
| 898 | Ac-Cyclo-[[Abu]-QTWQC]-[Phe[4-(2-aminoethoxy)]]-[2-Nal]-[Orn]-[Dap(Ac)]-NG-NH₂ | ***** | |
| 899 | Ac-Cyclo-[[Abu]-QTWQC]-[Phe[4-(2-aminoethoxy)]]-W-[hLeu]-ENG-NH₂ | ***** | ***** |
| 900 | Ac-Cyclo-[[Abu]-QTWQC]-[Phe[4-(2-(acetyl-aminoethoxy)]]-[2-Nal]-[α-MeLys(Ac)]-[Lys(Ac)]-NG-NH₂ | ** | ***** |
| 901 | Ac-Cyclo-[[Abu]-QTWQC]-[Phe[4-(2-aminoethoxy)]]-W-[α-Me-Leu]-ENG-NH2 | * | ** |
| 902 | Succicinyl-Cyclo-[[Abu]-QTWQC]-[Phe[4-(2-aminoethoxy)]]-[2-Nal]-[α-MeLys]-[Lys(Ac)]-NG-NH2 | * | ** |
| 906 | Ac-Cyclo-[[Abu]-QTWQC]-[Phe[4-(2-(acetyl-aminoethoxy)]]-[2-Nal]-[α-MeLys(Ac)]-ENG-NH₂ | **** | ***** |
| 820 | Ac-Cyclo-[[Abu]-QTWQC]-[Phe(4-OMe)]-[2-Nal]-[Chg]-[Lys(Ac)]-NG-NH₂ | * | ** |
| 911 | Ac-Cyclo-[[Abu]-QTWQC]-[Phe[4-(2-aminoethoxy)]]-[2-Nal]-[α-MeLys]-ENQ-NH₂ | ** | ** |
| 912 | Ac-Cyclo-[[Abu]-QTWQC]-[Phe[4-(2-aminoethoxy)]]-[2-Nal]-[α-MeLys]-ENN-NH₂ | ** | ** |
| 913 | Ac-Cyclo-[[Abu]-TTWQC]-[Phe[4-(2-aminoethoxy)]]-[2-Nal]-[α-MeLys]-ENG-NH₂ | ** | ** |
| 914 | Ac-Cyclo-[[Abu]-QTWQC]-[Phe[4-(2-aminoethoxy)]]-[2-Nal]-[α-Me-Gly(Ethyl)] Lys(Ac)]-NG-NH₂ | **** | ***** |
| 915 | Ac-Cyclo-[[Abu]-QTWQC]-[Phe[4-(2-aminoethoxy)]]-[2-Nal]-[α-MeVal]-[Lys(Ac)]-NG-NH₂ | *** | **** |
| 916 | Ac-Cyclo-[[Abu]-QTWQC]-[Phe[4-(2-aminoethoxy)]]-[2-Nal]-[α-MeSer]-[Lys(Ac)]-NG-NH₂ | ***** | *** |
| 925 | Ac-(D)Lys-[Cyclo-[[Abu]-QTWQC]]-[Phe(4-OMe)]-[2-Nal]-[α-MeLeu]-ENG-NH₂ | **** | ***** |
| 1039 | [Ac-[(D)Lys]-Cyclo-[[Abu]-QTWQC]-[Phe(4-OMe)]-[2-Nal]-[α-MeLeu]-ENG-NH₂]₂ DIG: dimerization through (D)Lys | **** | ***** |

TABLE 10-continued

Stability of Illustrative Peptides Containing Thioethers Motif and Analogues Within Simulated Intestinal Fluid (SIF) and Simulated Gastric Fluid (SGF)

| SEQ ID NO: | Sequence | SIF t$^{1}$/$_{2}$ (min) | SGF t$^{1}$/$_{2}$ (min) |
|---|---|---|---|
| 930 | Ac-Cyclo-[[Abu]-QTWQC]-[Phe[4-(2-aminoethoxy)]]-[2-Nal]-[hLeu]-[Lys(Ac)]-N-[βAla]-NH$_2$ | ***** | ND |
| 933 | Ac-Cyclo-[[Abu]-QTWQC]-[Phe[4-(2-aminoethoxy)]]-[2-Nal]-[α-MeLys]-NNG-NH$_2$ | ** | ** |
| 946 | Ac-Cyclo-[[Abu]-QTWQC]-[Phe[4-(2-aminoethoxy)]]-[2-Nal]-[Aib]-[Lys(Ac)]-NG-NH$_2$ | **** | **** |
| 955 | Ac-Cyclo-[[Abu]-QTWQC]-[Phe[4-(2-aminoethoxy)]]-[2-Nal]-[α-MeLeu]-[Lys(Ac)]-NN-NH$_2$ | *** | ***** |
| 1040 | [Ac-Cyclo-[[Abu]-QTWQC]-Y(Bzl)-W-[α-MeLys]-ENG-NH$_2$]$_2$; PEG25 through [α-MeLys] | ** | ***** |
| 965 | Ac-E-Cyclo-[[Abu]-QTWQC]-[Phe[4-(2-aminoethoxy)]]-[2-Nal]-[α-MeLys]-ENN-NH$_2$ | * | *** |
| 966 | Ac-(D)Glu-[Cyclo-[[Abu]-QTWQC]-[Phe[4-(2-aminoethoxy)]]-[2-Nal]-[α-MeLys]-ENN-NH$_2$ | * | **** |
| 967 | Ac-Arg-Cyclo-[[Abu]-QTWQC]-[Phe[4-(2-aminoethoxy)]]-[2-Nal]-[α-MeLys]-ENN-NH$_2$ | ***** | *** |
| 1041 | Ac-[(D)Arg-Cyclo-[[Abu]-QTWQC]-[Phe[4-(2-aminoethoxy)]]-[2-Nal]-[α-MeLys]-ENN-NH$_2$ | * | ** |
| 969 | Ac-F-Cyclo-[[Abu]-QTWQC]]-[Phe[4-(2-aminoethoxy)]]-[2-Nal]-[α-MeLys]-ENN-NH$_2$ | **** | *** |
| 970 | Ac-[(D)Phe]-Cyclo-[[Abu]-QTWQC]-[Phe[4-(2-aminoethoxy)]]-[2-Nal]-[α-MeLys]-ENN-NH$_2$ | ** | *** |
| 972 | Ac-T-Cyclo-[[Abu]-QTWQC]-[Phe[4-(2-aminoethoxy)]]-[2-Nal]-[α-MeLys]-ENN-NH$_2$ | * | *** |
| 973 | Ac-Leu-Cyclo-[[Abu]-QTWQC]-[Phe[4-(2-aminoethoxy)]]-[2-Nal]-[α-MeLys]-ENN-NH$_2$ | * | *** |
| 1042 | Ac-[(D)Gln]-Cyclo-[[Abu]-QTWQC]-[Phe[4-(2-aminoethoxy)]]-[2-Nal]-[α-MeLys]-ENN-NH$_2$ | * | *** |
| 975 | Ac-Cyclo-[[Abu]-QTWQC]-[Phe[4-(2-aminoethoxy)]]-[2-Nal]-[Acpc]-ENN-NH$_2$ | ***** | * |
| 976 | Ac-Cyclo-[[Abu]-QTWQC]-[Phe[4-(2-aminoethoxy)]]-[2-Nal]-[Acbc]-ENN-NH$_2$ | ***** | **** |
| 1043 | Ac-Cyclo-[[Abu]-QTWQC]-[Phe[4-(2-aminoethoxy)]]-[2-Nal]-[Acpc]-ENN-NH$_2$ | ** | * |
| 978 | Ac-Cyclo-[[Abu]-QTWQC]-[Phe[4-(2-aminoethoxy)]]-[2-Nal]-[Acvc]-ENN-NH$_2$ | *** | * |
| 979 | Ac-Cyclo-[[Abu]-QTWQC]-[Phe[4-(2-aminoethoxy)]]-[2-Nal]-[4-amino-4-carboxy-piperidine]-ENN-NH$_2$ | * | * |
| 972 | Ac-T-Cyclo-[[Abu]-QTWQC]-[Phe[4-(2-aminoethoxy)]]-[2-Nal]-[α-MeLys]-ENN-NH$_2$ | * | * |

§the matrix used is 100 fold dilution of standard SIF concentration
* = >360 min;
** = 180-360 minn;
*** = 120-180 min;
**** = <60-120 min;
***** = <60 min For each peptide tested, the DTT stability assay was conducted by adding 5 μl of a 10 mM peptide stock solution in DMSO to 1 ml of 100 mM Tris-C1, pH 7.5 (final peptide concentration is 50 μM). At time 0 min, 5 ul of a freshly thawed 100 mM DTT solution was added to the incubation tube containing the peptide, such that the final DTT concentration was 0.5 mM. The reactions were incubated at room temperature. At different time points up to 120 minutes (20 min, 40 min, 80 min, 120 min), 50 μl aliquots were removed, and the reaction was quenched by adding 10 μl of 5M acetic acid. To measure disappearance of the parent peptide, the quenched samples (30 μl) were analyzed by reverse phase HPLC and UV absorbance at 220 nm. The fraction oxidized remaining was graphed versus time, and half-lives were calculated by fitting to a first-order exponential decay equation using Excel. The results of these studies are shown in Table 11. The peptides having half-life >120 min are all considered stable.

TABLE 11

Stability of Illustrative Peptides in DTT Assay

| SEQ ID NO: | Sequence | DTT Stability (min) |
|---|---|---|
| 217 | Ac-CRTWECYWHEFG-NH$_2$ | <10 |
| 1044 | Ac-CQTWQCYW-[hLeu]-ENG-NH$_2$ | * |
| 1045 | Ac-CADWVWCYWHTFGA-[Azt]-[(D)Lys]-NH$_2$ | * |
| 1046 | Ac-Cyclo-[[Abu]-RTWQC]-YWRKFG-[AEA]-[(D)Lys]-NH$_2$ | >120 |
| 549 | Ac-[[Pen]-QTWQ-[Pen]-YW-[hLeu]-ENG-NH$_2$ | >120 |
| 554 | Ac-[Pen]-QTWQ-[Pen]-YW-[α-MeLeu]-ENG-NH$_2$ | >120 |
| 702 | Ac-Cyclo-[[Abu]-QTWQC]-[Phe(4-OMe)]-[2-Nal]-[α-MeLys]-ENG-NH$_2$ | >120 |
| 557 | Ac-[Pen]-QTWQ-[Pen]-[Phe(4-Ome)]-[2-Nal]-[α-MeLys]-ENG-NH$_2$ | >120 |
| 782 | Ac-Cyclo-[[Abu]-QTWQC]-[Phe[4-(2-aminoethoxy)]-W-[α-MeLys]-ENG-NH$_2$ | >120 |
| 980 | Ac-Cyclo-[[Abu]-QTWQC]-[Phe[4-(2-aminoethoxy)]]-[2-Nal]-[4-amino-4-carboxy-tetrahydropyran]-ENN-NH$_2$ | >120 |
| 534 | [Ac-[Pen]-QTWQ-[Pen]-[Phe(4-CONH$_2$)]-[2-Nal]-[α-MeLys]-[Lys(Ac)]-NN-NH$_2$]$_2$ DIG | >120 |

* = 10-120 min

Example 4

Cross-Reactivity of Peptide Inhibitors

The amino acids of the extracellular domain of the human IL-23R are 95%, 77% and 70% identical to the cyno IL-23R, rat IL-23R and mouse IL-23R, respectively. Interestingly, the mouse receptor contains an insertion of 21 residues that are absent in human, mouse, chimp, dog and cow receptor. These additional amino acids are located in a region where human IL-23R is thought to bind to IL-23.

To identify peptide inhibitors that cross-reacted with species other than human IL-23R, the ability of certain peptide inhibitors to inhibit human IL-23R, cyno IL-23R, rat IL-23R and mouse IL-23R by ELISA assay. In line with the observation regarding the sequence differences between human IL-23R and mouse IL-23R, the peptide antagonists tested showed a lack of or very weak inhibitory activities in the mouse IL-23R ELISA (see Table 12). In contrast, the antagonists tested to date displayed comparable potency towards the rat receptor and slightly less activity towards the cyno receptor.

Various bioassays performed to determine the potency, cross reactivity and the selectivity of IL-23R antagonists are described below.
Assays for Selectivity of Specific IL-23R Antagonists
Human IL-12Rβ1 ELISA An assay plate was coated with 100 ng/well of human IL-12Rβ1_huFC and incubated overnight at 4° C. The wells were washed, blocked, and washed again. Serial dilutions of test peptides and IL-23 at a final concentration of 2.5 nM were added to each well, and incubated for 2 hours at room temperature. After the wells were washed, bound IL-23 was detected with goat anti-p40 polyclonal antibodies, followed by an HRP conjugated donkey anti-goat IgG. Signals were visualized with TMB One Component HRP Membrane Substrate and quenched with 2 M sulfuric acid.

Mouse IL-23R Competitive Binding ELISA

An assay plate was coated with 50 ng/well of Mouse IL-23R_huFC and incubated overnight at 4° C. The wells were washed, blocked, and washed again. Serial dilutions of test peptides and IL-23 at a final concentration of 4 nM were added to each well, and incubated for 2 hours at room temperature. After the wells were washed, bound IL-23 was detected with goat anti-p40 polyclonal antibodies, followed by an HRP conjugated donkey anti-goat IgG. Signals were visualized with TMB One Component HRP Membrane Substrate and quenched with 2 M sulfuric acid.

Rat IL-23R Competitive Binding ELISA

An assay plate was coated with 300 ng/well of Rat IL-23R_huFC and incubated overnight at 4° C. The wells were washed, blocked, and washed again. Serial dilutions of test peptides and IL-23 at a final concentration of 7 nM were added to each well, and incubated for 2 hours at room temperature. After the wells were washed, bound IL-23 was detected with goat anti-p40 polyclonal antibodies, followed by an HRP conjugated donkey anti-goat IgG. Signals were visualized with TMB One Component HRP Membrane Substrate and quenched with 2 M sulfuric acid.

Cyno IL-23R Competitive Binding ELISA

An assay plate was coated with 50 ng/well of Cyno IL-23R_huFC and incubated overnight at 4° C. The wells were washed, blocked, and washed again. Serial dilutions of test peptides and IL-23 at a final concentration of 2 nM were added to each well, and incubated for 2 hours at room temperature. After the wells were washed, bound IL-23 was detected with goat anti-p40 polyclonal antibodies, followed by an HRP conjugated donkey anti-goat IgG. Signals were visualized with TMB One Component HRP Membrane Substrate and quenched with 2 M sulfuric acid.

TABLE 12

Cross-Reactivity of Illustrative Peptide Inhibitors

| Cmpd. Number | Human IL-23R Activity (nM) | | Rodent and Cyno IL-23R Cross Reactivity (nM) | | |
|---|---|---|---|---|---|
| | ELISA huIL23R IL23 | Cell Assay pSTAT3 HTRF | ELISA mouse IL23R IL23 | ELISA rat IL23R IL23 | ELISA cyno IL23R IL23 |
| 22 | + | + | − | + | + |
| 197 | ++ | ND | − | ++ | ND |
| 169 | ++ | ++ | − | ++ | + |
| 198 | +++ | +++ | ND | +++ | +++ |
| 213 | +++ | +++ | ND | +++ | ND |
| 219 | +++ | +++ | ND | +++ | ND |
| 230 | +++ | +++ | ND | +++ | ND |

+++ indicates 0-250 nM
++ indicates 251-1000 nM
+ indicates 1001-10,000 nM
− indicates > 25,000 nM

Example 5

NK Cell Assay

Natural killer (NK) cells, purified from human peripheral blood of healthy donors by negative selection (Miltenyi Biotech, Cat #130-092-657), were cultured in complete media (RPMI 1640 containing 10% FBS, L-glutamine and penicillin-streptomycin) in the presence of IL-2 (RnD, Cat #202-IL-010/CF) at 25 ng/mL. After 7 days, cells were centrifuged, and resuspended in complete media at 1E6 cells/mL. Recombinant IL-23 at predetermined EC50 to EC75 and IL-18 (RnD, Cat # B003-5) at 10 ng/mL were mixed with varying concentrations of peptides, and added to NK cells seeded at 1E5 cells per well. After 20 to 24 hours, IFNγ in the supernatant was quantified using Quantikine ELISA (RnD, Cat # DIF50).

TABLE 13

IC50 of Illustrative Peptide Inhibitors in Primary Cell Line (NK Cell Assay)

| SEQ ID NO: | Sequence | NK cell assay (nM) |
|---|---|---|
| 704 | Ac-Cyclo-[[Abu]-QTWQC]-Y-[2-Nal]-[α-MeLys]-ENG-NH$_2$ | * |
| 702 | Ac-Cyclo-[[Abu]-QTWQC]-[Phe(4-OMe)]-[2-Nal]-[α-MeLys]-ENG-NH$_2$ | * |
| 782 | Ac-Cyclo-[[Abu]-QTWQC]-[Phe[4-(2-aminoethoxy)]-W-[α-MeLys]-ENG-NH$_2$ | * |
| 861 | Ac-Cyclo-[[Abu]-QTWQC]-[Phe[4-(2-aminoethoxy)]]-[2-Nal]-[α-MeLys]-[Lys(isovaleric acid)]-NG-NH$_2$ | * |
| 877 | Ac-Cyclo-[[Abu]-QTWQC]-[Phe[4-(2-aminoethoxy)]]-[2-Nal]-[Aib]-QNG-NH$_2$ | * |
| 880 | Ac-Cyclo-[[Abu]-QTWQC]-[Phe[4-(2-aminoethoxy)]]-[2-Nal]-[Aib]-[Lys(Ac)]-NA-NH$_2$ | * |
| 900 | Ac-Cyclo-[[Abu]-QTWQC]-[Phe[4-(2-(acetyl-aminoethoxy)]]-[2-Nal]-[α-MeLys(Ac)]-[Lys(Ac)]-NG-NH$_2$ | * |
| 908 | Ac-Cyclo-[[Abu]-QTWQC]-[Phe[4-(2-aminoethoxy)]]-[Phe(3,4-OMe$_2$]-[α-MeLys]-[Lys(Ac)]-NG-NH$_2$ | * |
| 911 | Ac-Cyclo-[[Abu]-QTWQC]-[Phe[4-(2-aminoethoxy)]]-[2-Nal]-[α-MeLys]-ENQ-NH$_2$ | * |
| 912 | Ac-Cyclo-[[Abu]-QTWQC]-[Phe[4-(2-aminoethoxy)]]-[2-Nal]-[α-MeLys]-ENN-NH$_2$ | * |
| 915 | Ac-Cyclo-[[Abu]-QTWQC]-[Phe[4-(2-aminoethoxy)]]-[2-Nal]-[α-MeVal]-[Lys(Ac)]-NG-NH$_2$ | * |
| 1038 | [Ac-Cyclo-[[Abu]-QTWQC]-[Phe(4-OMe)]-[2-Nal]-[α-MeLys]-ENG-NH2]$_2$; DIG through α-MeLys | * |
| 954 | Ac-Cyclo-[[Abu]-QTWQC]-[Phe[4-(2-aminoethoxy)]]-[2-Nal]-[α-MeLeu)-[Cit]-NN-NH$_2$ | * |
| 970 | Ac-[(D)Phe]-Cyclo-[[Abu]-QTWQC]-[Phe[4-(2-aminoethoxy)]]-[2-Nal]-[α-MeLys]-ENN-NH$_2$ | * |
| 972 | Ac-T-Cyclo-[[Abu]-QTWQC]-[Phe[4-(2-aminoethoxy)]]-[2-Nal]-[α-MeLys]-ENN-NH$_2$ | * |
| 976 | Ac-Cyclo-[[Abu]-QTWQC]-[Phe[4-(2-aminoethoxy)]]-[2-Nal]-[Acbc]-ENN-NH$_2$ | * |

TABLE 13-continued

IC50 of Illustrative Peptide Inhibitors in Primary Cell Line (NK Cell Assay)

| SEQ ID NO: | Sequence | NK cell assay (nM) |
|---|---|---|
| 1043 | Ac-Cyclo-[[Abu]-QTWQC]-[Phe[4-(2-aminoethoxy)]]-[2-Nal]-[Acpc]-ENN-NH$_2$ | * |
| 1047 | Ac-Cyclo-[[Abu]-QTWQC]-[Phe[4-(2-aminoethoxy)]]-[2-Nal]-[Achc]-ENN-NH$_2$ | * |
| 980 | Ac-Cyclo-[[Abu]-QTWQC]-[Phe[4-(2-aminoethoxy)]]-[2-Nal]-[4-amino-4-carboxy-tetrahydropyran]-ENN-NH$_2$ | * |
| 984 | Ac-Cyclo-[[Abu]-QTWQC]-[Phe[4-(2-aminoethoxy)]]-[2-Nal]-[α-MeLeu]-QN-[βAla]-NH$_2$ | * |
| 992 | Ac-(D)Phe-Cyclo-[[Abu]-QTWQC]-[Phe[4-(2-aminoethoxy)]]-[2-Nal]-[4-amino-4-carboxy-tetrahydropyran]-ENN-NH$_2$ | * |
| 993 | Ac-[(D)Arg]-Cyclo-[[Abu]-QTWQC]-[Phe[4-(2-aminoethoxy)]]-[2-Nal]-[4-amino-4-carboxy-tetrahydropyran]-ENN-NH$_2$ | * |

* = <25 nM

TABLE 14

IC50 of Illustrative Peptides Containing the Ac-[Pen]-XXWX-[Pen]-XXXX Motif and analogues (NK cell assay)

| SEQ ID NO: | Sequence | NK Cell assay (nM) |
|---|---|---|
| 602 | Ac-[Pen]-QTWQ-[Pen]-[Phe[4-(2-aminoethoxy)]]-[2-Nal]-[α-MeLeu]-[Lys(Ac)]-NN-NH$_2$ | * |
| 632 | Ac-[Pen]-NTWQ-[Pen]-[Phe[4-(2-aminoethoxy)]]-[2-Nal]-[Aib]-[Lys(Ac)]-NN-NH$_2$ | * |
| 639 | Ac-[Pen]-NTWQ-[Pen]-[Phe[4-(2-aminoethoxy)]]-[2-Nal]-[Aib]-[Lys(Ac)]-N-[βAla]-NH$_2$ | * |
| 666 | Ac-[Pen]-QTWQ-[Pen]-[Phe(4-OMe)]-[2-Nal]-[α-MeLys]-[Lys(Ac)]-NN-NH$_2$ | * |
| 668 | Ac-[Pen]-QTWQ-[Pen]-[Phe(4-CONH2)]-[2-Nal]-[α-MeLys]-[Lys(Ac)]-NN-NH$_2$ | * |
| 669 | Ac-[Pen]-QTWQ-[Pen]-[Phe(4-CONH2)]-[2-Nal]-[α-MeVal]-[Lys(Ac)]-NN-NH$_2$ | ** |
| 530 | [Ac-[Pen]-QTWQ[Pen]-[Phe[4-(2-acetylaminoethoxy)]-[2-Nal]-[α-MeVal]-KNN-NH$_2$]$_2$ DIG | * |
| 531 | [Ac-[Pen]-QTWQ[Pen]-[Phe[4-(2-acetylaminoethoxy)]-[2-Nal]-K-[Lys(Ac)]-NN-NH$_2$]$_2$ DIG | * |
| 532 | [Ac-[Pen]-QTWQ-[Pen]-[Phe(4-OMe)]-[2-Nal]-[α-MeLys]-[Lys(Ac)]-NN-NH$_2$]$_2$ DIG | * |
| 534 | [Ac-[Pen]-QTWQ-[Pen]-[Phe(4-CONH$_2$)]-[2-Nal]-[α-MeLys]-[Lys(Ac)]-NN-NH$_2$]$_2$ DIG | * |
| 1048 | Ac-[(D)Phe]-[Pen]-NTWQ[Pen]-[Phe(4-OMe)]-[2-Nal]-[4-amino-4-carboxy-tetrahydropyran]-[Cit]-NN-NH$_2$ | * |
| 1049 | Ac-[(D)Phe]-[Pen]-NTWQ[Pen]-[Phe(4-OMe)]-[2-Nal]-[Achc]-ENN-NH$_2$ | * |
| 1050 | Ac-[Pen]-NTWQ[Pen]-[Phe(CONH$_2$)]-[2-Nal]-[Aib]-[Lys(Ac)]-NN-NH$_2$ | * |
| 535 | [Ac-[Pen]-NTWQ-[Pen]-[Phe(4-CONH$_2$)]-[2-Nal]-[Aib]-KNN-NH$_2$]$_2$ DIG | * |

* = <10 nM;
** = 10-25 nM

Example 6

Bioassay Characterization of Peptide Inhibitors

The potency, cross reactivity, and selectivity of certain peptide inhibitors was determined using various bioassays developed for this purpose and described below.

Rat Splenocyte Assay

A new assay developed was the rat splenocyte assay. This assay examined the levels of IL-17A in activated rat splenocytes following stimulation with IL-23 in the presence of test compound.

Briefly, splenocytes freshly isolated from rat were seeded in 96-well tissue culture plates in complete medium containing concanavalin A. Serial dilutions of test compounds were distributed to each well along with rat IL-23 at a final concentration of 4 ng/mL; plates then were incubated for 3 days at 37° C. in a 5% $CO_2$ humidified incubator. Changes in IL-17A levels in the supernatants were detected using an ELISA. FIG. 1 shows an example of IL-17A levels produced by rat splenocytes in response to rat IL-23 stimulation.

Rat Colitis Model: 9 Days of 3% DSS-Containing Drinking Water

There is a body of evidence in the literature supporting the pathogenic role of IL-23/IL-23R signaling in animal models of colitis. For the IL-23 ligand, this requirement has been shown in multiple models, including an $IL-10^{-/-}$ spontaneous colitis model, a *Helicobacter hepaticus*-driven colitis model, the anti-CD40 innate colitis model, and the chronic $CD45RB^{high}$ $CD4^+$ T-cell transfer model. For the IL-23 receptor, the requirement for colitis development has been shown in the acute models of colitis induced by DSS or by anti-CD40, as well as the chronic $CD45RB^{high}$ $CD4^+$ T-cell transfer model. Since certain peptide inhibitors of the present invention do not cross react with the IL-23 receptor from mouse but do recognize that from the rat, a rat model of IBD relevant to the IL-23 pathway was developed.

In this model, colitis was induced in SD rats by 9 days of ad lib exposure to drinking water containing 3% DSS. The disease activity index (DAI) score and ratio of colon weight:colon length were compared between three study groups (n=6 rats/group): vehicle, 3% DSS, and 3% DSS with positive control (sulfasalazine administered at 100 mg/kg PO, QD). The DAI score consisted of ratings from three parameters, including percent body weight loss, stool consistency, and a quantitative hemoccult score, and could achieve a maximum value of 3 units. DSS-exposed animals displayed significantly elevated DAI score (compared to vehicle control) from Day 4 onward, with DAI values peaking at approximately 2.5 by the end of the study (Day 9). Treatment of the DSS-exposed rats with the positive control (sulfasalazine) attenuated the disease score (compared to DSS alone) from Day 5. The differences observed in the terminal ratio of colon weight:colon length also were significant for DSS-induced disease animals with and without sulfasalazine treatment.

Ex Vivo Activity and Stability

Two peptides (Compound A and Compound B) were selected for use in further biological studies (shown below). One contained a thioether linkage and the other contained a Pen-Pen disulfide bond. The activity, selectivity and ex vivo stability profiles of the two compounds are provided herein.

Assays for selectivity of peptide inhibitors included a human IL-12Rb1 ELISA and measurement of the production of IL-12 in PHA activated human PBMC, which are described briefly below.

Human IL-12Rβ1 ELISA

An assay plate was coated with 100 ng/well of human IL-12Rb1 huFC and incubated overnight at 4° C. The wells were washed, blocked, and washed again. Serial dilutions of test peptides and IL-23 at a final concentration of 2.5 nM were added to each well, and incubated for 2 hours at room temperature. After the wells were washed, bound IL-23 was detected with goat anti-p40 polyclonal antibodies, followed by an HRP conjugated donkey anti-goat IgG. Signals were visualized with TMB One Component HRP Membrane Substrate and quenched with 2 M sulfuric acid. Data from these assays is provided herein.

Production of IFNγ by IL-12 in PHA Activated Human PBMC

Figure 2:
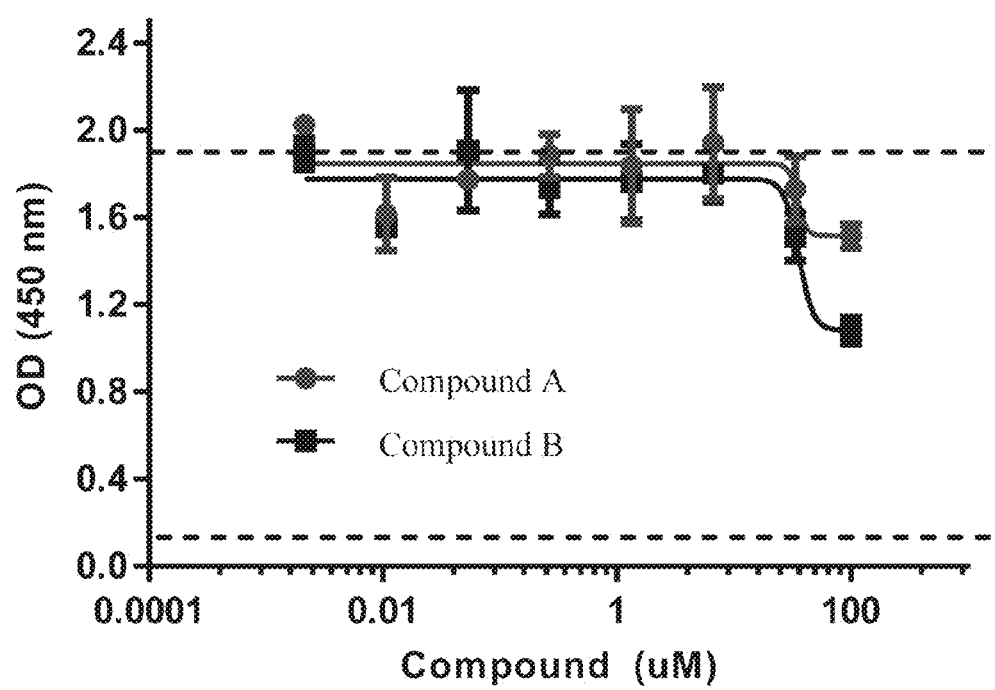
FIG. 2 is a graph showing IL-12-dependent production of IFNγ from human PBMCs treated with the indicated amounts of Compound A or Compound B.

This assay examined the ability of IL-23R antagonists to neutralize production of IFNγ proteins in IL-12-stimulated human PBMCs. IL-23R peptide inhibitors specific to the IL-23/IL-23R pathway are not expected to alter the levels of IFNγ produced. Compound A and Compound B were tested in this assay, and a graph showing that they do not alter the levels of IFNγ produced at most concentrations tested is provided in FIG. 2.

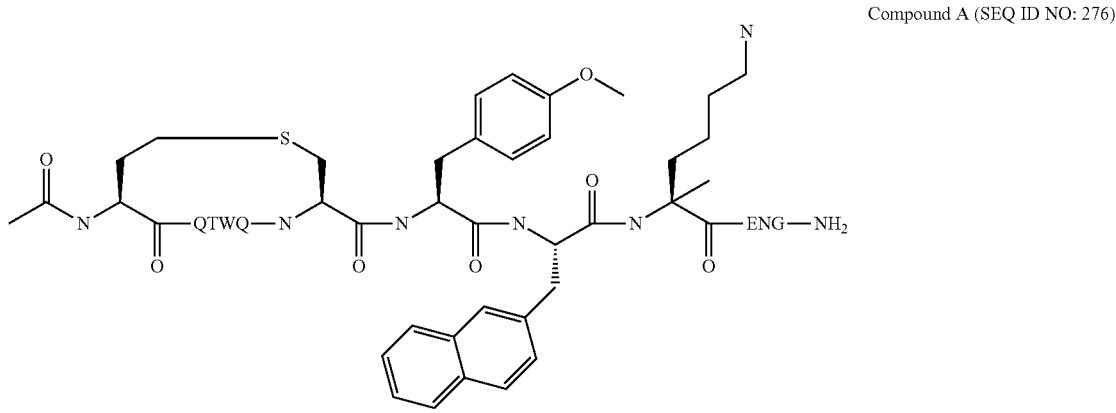

Compound A (SEQ ID NO: 276)

-continued

Compound B (SEQ ID NO: 279)

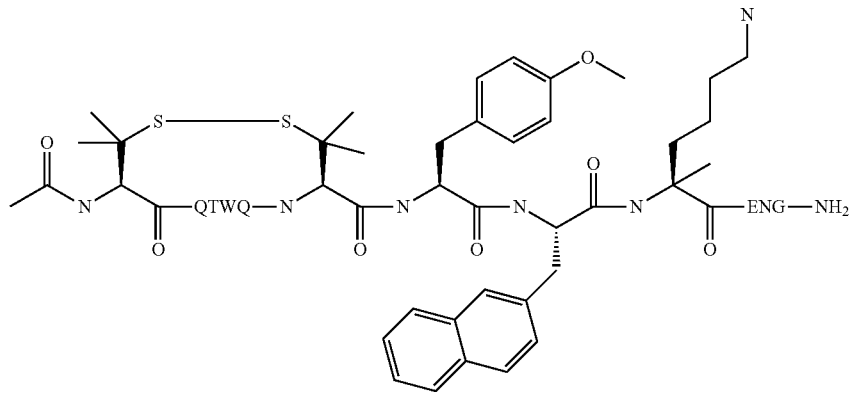

In Vivo Activity

Acute colitis was induced by feeding female Sprague Dawley rats with 3% (wt/vol) DSS dissolved in drinking water. For nine days starting at the same day as DSS, Compounds A or B was administered orally three times per day at 20 mg/kg or 30 mg/kg. Compounds A was also administered intraperitoneally three times per day at 30 mg/kg. A neutralizing anti-IL-23p19 antibody was used as a comparator, and was administered intraperitoneally at 4 mg/kg on the same day and fifth day after starting DSS. To quantify colitis with clinical activity, disease activity index (DAI) was determined daily for each animal as an average of three parameters: body weight change (scale 0-3), stool consistency (scale 0-3) and hemoccult blood (scale 0-3), as shown in Table 15. At necropsy, the entire colon was removed from the cecum to the rectum. The colon was measured for length, flushed with PBS to remove feces, weighed, and opened longitudinally to determine macroscopic score. The visible damage of the colon was scored on a scale from 0-3, as shown in Table 16.

Figures 3A, 3B:
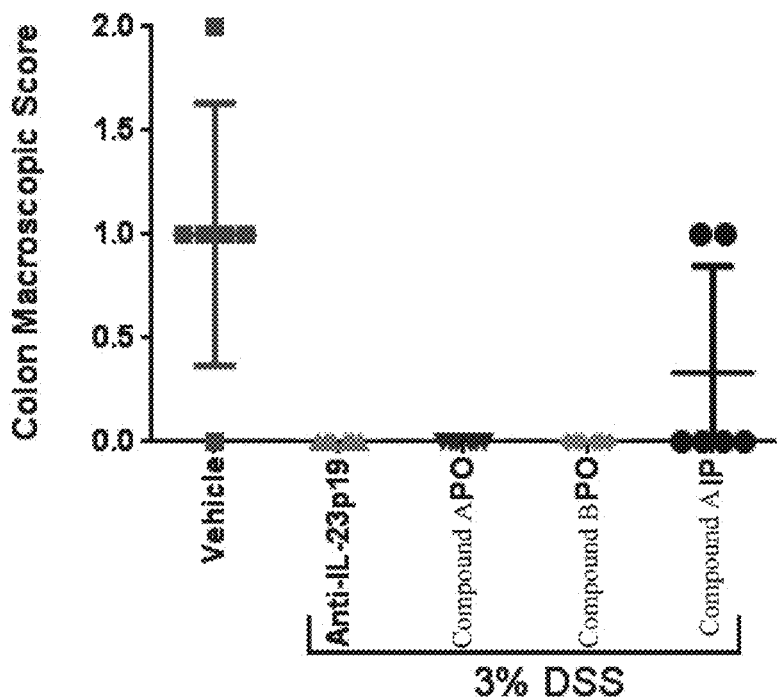
FIGS. 3A and 3B show results for DAI values from Day 7 (FIG. 3A and FIG. 3B). Statistical analysis for significance was determined using Student's t-test (GraphPad Prism). Differences were noted as significant *p<0.05, p<0.01, *p<0.001, ****p<0.0001.

Table 17 shows that at Day 7, treatment with Compound A and B significantly improved DAI scores compared to vehicle treated group. FIG. 3 shows results for DAI values from Day 7. In addition, a significant reduction was also observed in the colon weight to colon length ratios, and colon macroscopic scores. The reduction in inflammation observed with orally delivered peptides was similar to the effects observed from neutralizing anti-IL23p19 monoclonal antibody. Statistical analysis for significance was compared to the vehicle treated group and was determined using Student's T-test (GraphPad Prism). Differences were noted as significant *$p<0.05$, $p<0.01$, *$p<0.001$, ****$p<0.0001$.

TABLE 15

Scoring of the Disease Activity Index

| Score | Percent Body Weight Change | Stool Consistency | Hemoccult Score |
|---|---|---|---|
| 0 | None | Normal | Normal |
| 1 | 1 to 7 | Semi solid | Guaiac+ |
| 2 | 8 to 15 | Loose | Bleeding+ |
| 3 | >15 | Diarrhea | Bleeding++ |

TABLE 16

Scoring of Gross Morphologic Damage of the Colon

| Score | Gross morphology |
|---|---|
| 0 | Normal |
| 1 | Erythemia |
| 2 | Erythemia, slight edema, small erosions |
| 3 | Two are more bleeding ulcers, inflammation, moderate adhesions |
| 4 | Severe ulceration, stenosis with dilations, severe adhesions |

TABLE 17

Disease activity index scores and the individual parameters scores at Day 7, colon weight to length ratios and colon macroscopic scores at Day 9.

| | Day 7 | | | | | | | | Day 9 Necropsy | | | |
|---|---|---|---|---|---|---|---|---|---|---|---|---|
| | Percent Body Weight Change | | Stool Consistency | | Hemoccult Score | | DAI | | Colon Weight/Length (g/cm) | | Colon Macrosopic Score | |
| Group | Mean | SD | Mean | SD | Mean | SD | Mean | SD | Mean | SD | Mean | SD |
| No DSS | 11.00 | 2.08**** | 0 | 0**** | 0 | 0**** | 0 | 0**** | 75.51 | 7.03*** | ND | ND |
| 3% DSS, Vehicle | −6.39 | 1.11 | 2.00 | 0.58 | 1.50 | 0.50 | 1.72 | 0.45 | 124.36 | 17.11 | 1.00 | 1.00 |
| Anti-IL23p19 mAb | −0.05 | 1.92**** | 1.00 | 0.58* | 0.50 | 0.5* | 0.67 | 0.43** | 99.96 | 16.19* | 0.00 | 0** |
| Compound A, PO | 3.18 | 2.09**** | 1.17 | 0.90 | 0.50 | 0.5* | 0.56 | 0.46** | 98.38 | 6.91* | 0.00 | 0** |

TABLE 17-continued

Disease activity index scores and the individual parameters scores at Day 7,
colon weight to length ratios and colon macroscopic scores at Day 9.

| | Day 7 | | | | | | | | Day 9 Necropsy | | | |
|---|---|---|---|---|---|---|---|---|---|---|---|---|
| | Percent Body Weight Change | | Stool Consistency | | Hemoccult Score | | DAI | | Colon Weight/Length (g/cm) | | Colon Macrosopic Score | |
| Group | Mean | SD | Mean | SD | Mean | SD | Mean | SD | Mean | SD | Mean | SD |
| Compound B, PO | 0.13 | 1.24**** | 0.83 | 0.69* | 0.67 | 0.47* | 0.61 | 0.3*** | 97.36 | 9.32* | 0.00 | 0** |
| Compound A, IP | −0.50 | 1.88*** | 1.17 | 0.69 | 0.83 | 0.69 | 0.83 | 0.54* | 104.32 | 12.45 | 0.33 | 0.47 |

Example 7

In Vitro Assays and Surface Plasmon Resonance (SPR) Analysis

In vitro assays and SPR were performed to further characterize an illustrative compound, Compound C:

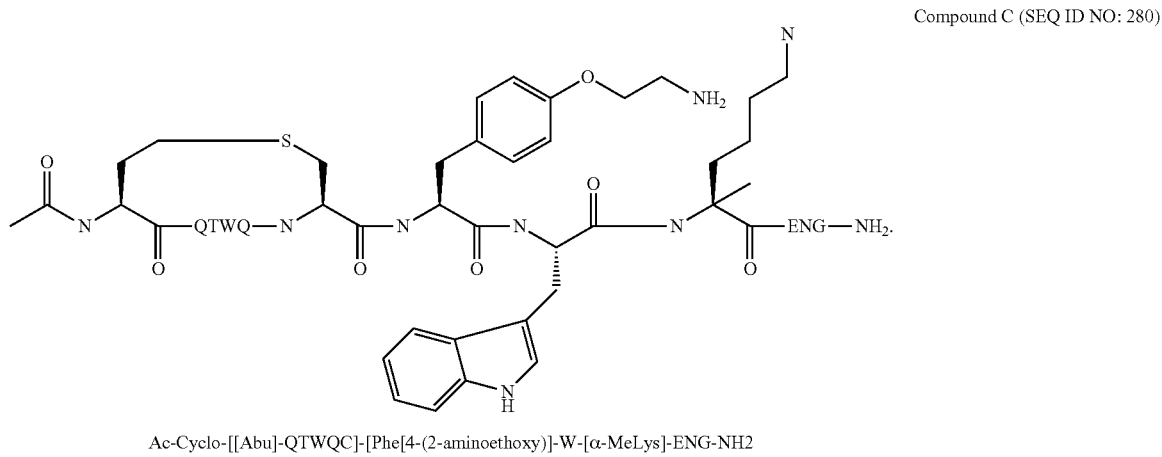

Compound C (SEQ ID NO: 280)

Ac-Cyclo-[[Abu]-QTWQC]-[Phe[4-(2-aminoethoxy)]-W-[α-MeLys]-ENG-NH2

Assays described in previous examples were performed to demonstrate that Compound C is a potent, selective and competitive inhibitor of IL-23R, showing potent inhibition of IL-23-dependent upregulation of phosphor-STAT3 (pSTAT3) in human DB cells and IFNγ production in human peripheral blood natural killer (PB NK) cells. In addition, Compound C was selective, showing little inhibition in a cell free ELISA for human IL6R, or in IL-12-dependent production of IFNg in PBMC. Data is shown below in Table 18A. Compound C also cross-reacted with cynomolgus IL-23R (IC50 7 nM) and rat IL-23R (IC50 17 nM), and inhibited IL-23-dependent IL-17A production in rat splenocytes (IC50 130 nM) (data not shown).

TABLE 18A

In vitro Characterization of Compound C

| | IC50 | | | | KD | |
|---|---|---|---|---|---|---|
| | pSTAT3/ DB Cell Assay | IFNγ/PB NK Primary Cell Assay | IL-6/IL-6R ELISA | IFNγ/IL-12 PBMC Cell Assay | IL-23R Surface | IL-12Rβ1 Surface |
| Compound C | 4 nM | 27 nM | >100 uM | >100 uM | 2.4 nM | None |

Compound C exposure was also restricted to the GI following oral administration to rats does PO at 20 mg/kg, with AUC values of 355 ug·h/g for small intestine mucosa; 77 ug·h/g for colon mucosa; and 0.3 ug·h/mL for plasma, with a 40% recovery in feces.

Compound C was also stable in a variety of GI fluids and reducing environment, having a SIF half-life of >24 h; a SGF half-life of >24 h; a human intestinal fluid half-life of >24 h, and a half-life of >2 h in a DTT assay.

SPR experiments were carried out using a Biacore 2000 instrument and T100 optical biosensors equipped with Biacore CM4 and Xantec HC1500m sensor chips. Recombinant human IL-23R_huFC (RnD), or recombinant human IL-12Rβ1 huFC (RnD) or a mixture of the two receptor subunits were captured on an anti-human IgG surface. Recombinant human IL-23 (Humanzyme) or Compound C was used as the analyte. SPR sensorgrams were fitted to a one to one interaction model, giving rise to a rough estimate of the association rate constant ($k_{on}$), dissociation rate constant ($k_{off}$) and dissociation constant ($K_D$) of the complexes, as shown in Table 11. The data show that Compound C does not bind to IL-12Rβ1, and binds to IL-23R and the mixed surface of IL-12Rβ1 and IL-23R with similar potency, at 2.42 nM and 2.56 nM, respectively. This affinity for IL-23R is comparable to that from IL-23. In contrast, the affinity of IL-23 to the mixed surface is approximately 14× faster than that from Compound C.

TABLE 18B

Binding characteristics of IL-23 and Compound C for IL-12Rβ1, IL-23R or mixed IL-12Rβ1 and IL-23R as determined by SPR.

| Surface | IL-23 | | | Compound C | | |
|---|---|---|---|---|---|---|
| | $k_a$(M−1 sec−1) | $k_d$ (sec−1) | $K_D$ (nM) | $k_a$(M−1 sec−1) | $k_d$ (sec−1) | $K_D$ (nM) |
| IL-12Rb1_huFC | 5.01E+05 | 4.38E−04 | 0.87 | does not bind up to 16.7 uM | | |
| IL-23R_huFC | 7.82E+05 | 0.00132 | 1.69 | 1.37E+07 | 0.033 | 2.42 |
| IL-12Rb1_huFC/IL-23R_huFC | 6.31E+05 | 1.15E−04 | 0.18 | 1.59E+07 | 0.041 | 2.56 |

Example 8

Efficacy of IL-23R Antagonists in TNBS Induced Colitis in Rat

To further evaluate the efficacy of IL-23R antagonists in an animal model of disease, acute colitis was induced by providing 7-week-old female Sprague-Dawley rats with 60 mg/kg 2,4,6-Trinitrobenzenesulfonic acid (TNBS) in 45%-50% ethanol (TNBS/ethanol) administered intrarectally at Day 0. Compound C (described in Example 7) was administered orally three times a day at 20 mg/kg or 6.7 mg/kg and was provided in drinking water at 0.6 mg/mL or 0.2 mg/mL, respectively, for 8 days starting approximately 24 hours (Day −1) prior TNBS inoculation. A neutralizing anti-IL-23p19 antibody was used as a comparator, and was administered intraperitoneally at 4 mg/kg on Day −1 and again on Day 3. All animals received orally PBS (pH 7.4) vehicle which was used to formulate Compound C. The study design in shown in FIG. 5.

To assess the extent of the inflammatory response, animals were observed daily for clinical signs which included percent body weight loss and signs of loose stools or diarrhea. Six days after inoculation of TNBS, rats were sacrificed and the entire colon length and colon weight from cecum to rectum from each animal were recorded. The severity of colitis was evaluated by a pathologist blinded to the identity of treatments. In addition to the colon wall thickness, the gross colon damage was scored on a 0-4 scale according to Table 19 below, and histopathological scores were determined based on below parameters (Tables 20 and 21).

TABLE 19

Definitions for colon macroscopic scores

| Score | Colon Gross Morphology |
|---|---|
| 0 | Normal |
| 1 | Erythema |
| 2 | Erythema, slight edema, small erosions |
| 3 | Two or more bleeding ulcers, inflammation, moderate adhesions |
| 4 | Severe ulceration, stenosis with dilations, severe adhesions |

TABLE 20

Definitions for histopathology

| Parameter | Definition |
|---|---|
| Inflammation | Extent and severity of inflammatory cells infiltration, localized and/or diffuse involving full thickness of the colon section (transmural). Inflammatory cells include polymorpho-nuclear leukocytes (neutrophils), mononuclear cells (macrophages + lymphopcytes), fibroplasia and neovascularization. |
| Mucosal Necrosis | Necrosis in the mucosa with loss of surface epithelium, hemorrhage and cellular debris; measured as the length of the lesion on the total length of the colon section to determine % area affected |
| Gland Loss | % crypt epithelial degeneration with or without superficial mucosal erosion |
| Colon Thickness | the average thickness of the colon measured transmurally (full thickness) from the mucosal surface to the serosa |

TABLE 21

Scoring criteria

Score

Inflammation

0   Normal tissue, no inflammation
0.5 Very minimal localized infiltrates in the superficial mucosa affecting <2% of the colon section
1   Minimal degree of multifocal infiltrates in the mucosa affecting approximately 2-10% of the colon section
2   Mild degree of multifocal infiltrates in the mucosa, submucosa, outer muscle band, and serosa affecting approximately 11-25% of the colon section
3   Moderate degree of multifocal infiltrates in the mucosa submucosa, outer muscle band and serosa affecting approximately 26-50% of the colon section
4   Marked degree of multifocal to diffuse infiltrates in the mucosa submucosa, outer muscle band and serosa affecting approximately 51-75% of the colon section
5   Sever degree of multifocal to diffuse infiltrates in the mucosa submucosa, outer muscle band and serosa affecting approximately >75% of the colon section Mucosal Necrosis 0   No Necrosis
0.5 Very minimal and localized region affecting <2% of the total colon section
1   Minimal focal to multifocal regions affecting 2-10% of the total colon section
2   Mild focal to multifocal regions affecting 11-25% of the total colon section
3   Moderate focal to multifocal regions affecting 26-50% of the total colon section
4   Marked focal to multifocal regions affecting 51-75% of the total colon section
5   Severe focal to multifocal regions affecting >75% of the total colon section Gland Loss 0   No loss, normal crypt epithelium and mucosa
0.5 Very minimal loss not exceeding 1-2 regions of mucosa/gland affected
1   Minimal, 1-10% regions of mucosa/gland affected
2   Mild, 11-25% regions of mucosa/gland affected
3   Moderate, 26-50% regions of mucosa/gland affected
4   Marked, 51-75% regions of mucosa/gland affected
5   Severe, >75% regions of mucosa/gland affected Colon Thickness 0   Normal = <350 microns or less
0.5 Very Minimal = 351-400 microns
1   Minimal = 400-500 microns
2   Mild = 501-600 microns
3   Moderate = 601-700 microns
4   Marked = 701-800 microns
5   Severe = >801 microns Compared to the sham group, rats challenged with TNBS suffered acute weight loss, displayed increased incidence of loose stools, and increased colon weight to length ratio. These data were confirmed by the macroscopic examination of colon which revealed mild colonic injury characterized by erythema, edema and small erosions. Treatment with Compound C attenuated these changes as compared to the TNBS colitis group. At the high dose, Compound C was significantly effective in reducing the colon weight to length ratio, diminishing the thickness of the colon walls, and more importantly, improving the colon gross pathology scores to normal in 70% of the animals. Statistical significances were observed at the low dose in all above indications except colon wall thickness although a trend was evident. The reduction in inflammation observed with orally delivered Compound C was similar to the effect observed from the neutralizing anti-IL-23p19 monoclonal antibody (FIG. 6).

Figure 7:
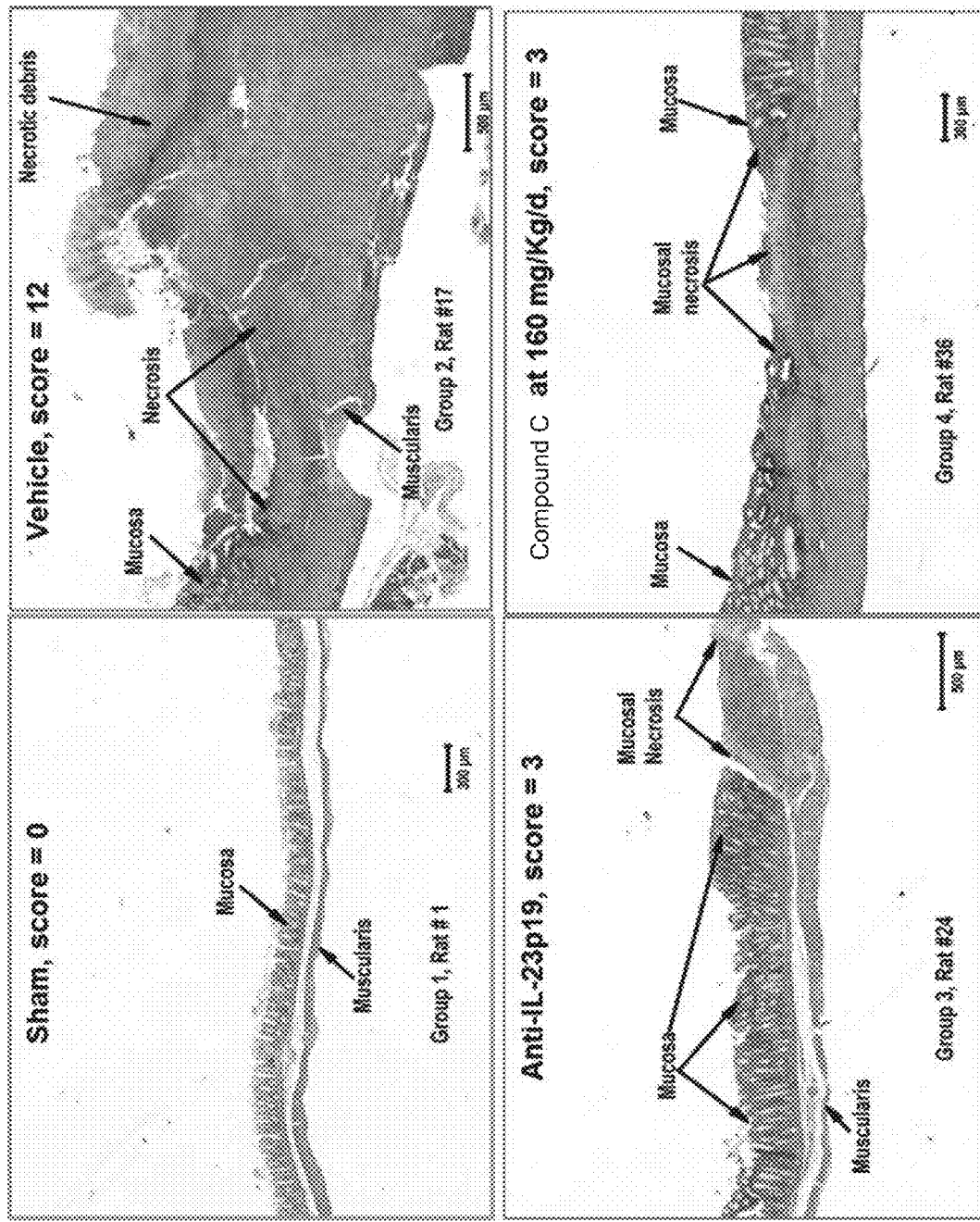
FIG. 7 provides micrographs of colon lesions found in animals following sham treatment (upper left panel), vehicle treatment (upper right panel) showing transmural inflammation, presence of necrotic tissue, and mucosa devoid of crypts, anti-IL23p19 antibody (lower left panel), or 160 mg/kg/d Compound C (lower right panel) showing restriction of lesions to the mucosa.

Histological examination of H&E stained distal colons show that the majority of the lesions observed from the vehicle group are transmural, characterized by necrosis with inflammatory cells transversing the entire thickness of the colon, presence of necrotic tissue debris on the lumen surface, and mucosa devoid of crypts. The animals treated with Compound C generally showed localized lesions limited in the mucosa and submucosa regions, with colon tissues showed potential signs of healing at sites of necrosis (FIG. 7). Specifically, the animals treated with 160 mg/kg/d Compound C showed a significant reduction in inflammation, mucosal necrosis and colon wall thickness leading to a significant reduction in the overall histological score, comparable to that from the anti-IL-23p19 antibody control (FIG. 8).

Figures 9A, 9B, 9C:
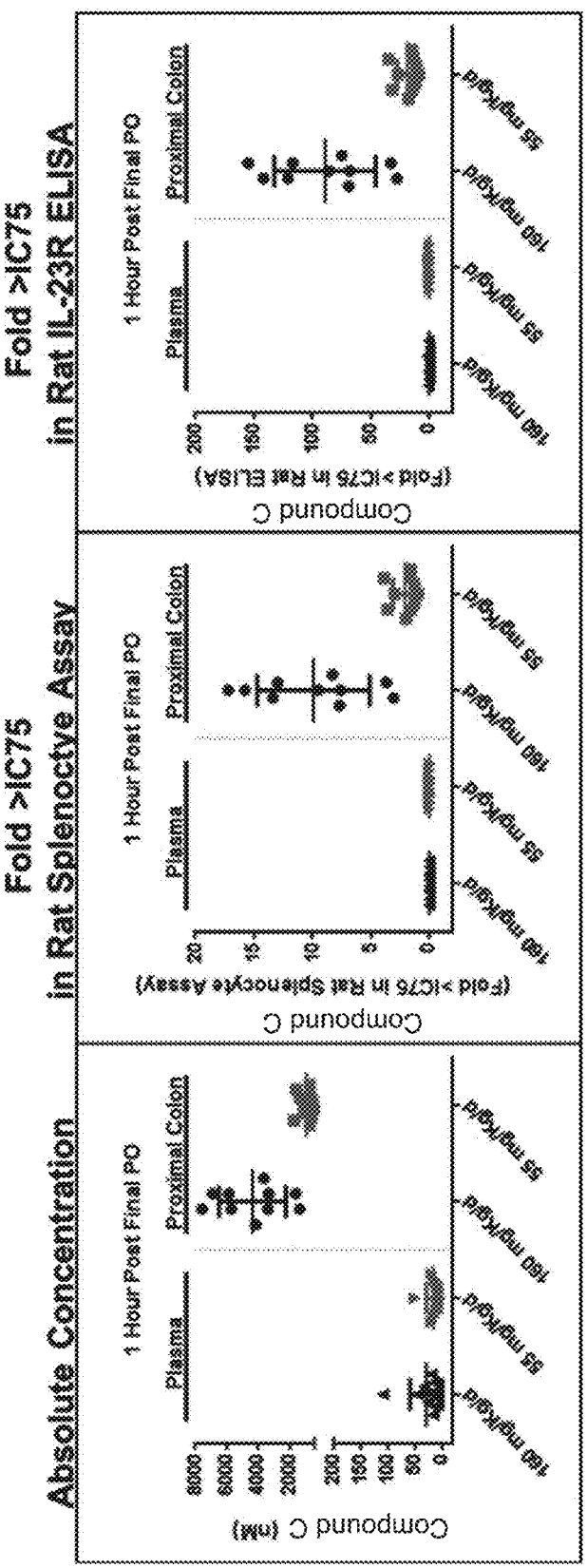
FIGS. 9A-9C shows the concentration of Compound C in the plasma and proximal colon determined one hour post last PO dose (9A; left panel), and fold above IC75 of its activity as determined by the rat splenocyte assay (9B; middle panel) and the rat IL23R ELISA assay (9C; right panel).

Concentration analysis of samples collected 1 hour post the last PO dose show that the plasma concentrations of Compound C detected from all animals are <=2x below the IC75 of the compounds as determined in the rat splenocyte/IL-17A cell based assay or the rat IL-23R ELISA, suggesting that the efficacies observed from oral treatment are most likely due to its local activity at the colon (FIG. 9). Collectively, these data highlights the protective effect of an IL-23R antagonist in the development of TNBS colitis.

These studies demonstrate that peptides of the present invention are potent, selective and orally efficacious ILweR peptide antagonists that are promising therapeutics for the treatment of IBD and other disorders. As shown herein, the present invention provides peptides that are: potent blockers of IL-23/IL-23R signaling in a human cell line and in human primary cells; selective for IL-23R, and do not inhibit binding to IL-6R or signaling through IL-12R; cross-reactive towards rat and cynomolgus but not mouse homologs, enabling in vivo studies in these species; resistant to proteolytic and reducing environments of the GI, resulting in high drug levels in the intestinal tissues and limited drug concentrations in the circulation, offering potential safety advantages over systemically delivered therapeutics; and effective and comparable to an anti-IL23p19 monoclonal antibody in attenuating colitis in a TNBS-induced rat colitis model, most like through GI-restricted activities.

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

From the foregoing it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (1114 sequences)

SEQ ID NO: 1 - protein, 12 aa, Artificial Sequence
  Description of Artificial Sequence: Synthetic peptide
  MOD_RES (1)..(1): Aib
  MOD_RES (2)..(2): Aib
  MOD_RES (11)..(11): Aib
XXTWQDYWLYXR

SEQ ID NO: 2 - protein, 14 aa, Artificial Sequence
  Description of Artificial Sequence: Synthetic peptide
CAMTWQDYWLYGRC

SEQ ID NO: 3 - protein, 12 aa, Artificial Sequence
  Description of Artificial Sequence: Synthetic peptide
  MOD_RES (1)..(1): Aib
  MOD_RES (2)..(2): Aib
XXTWQDYWLYGR

SEQ ID NO: 4 - protein, 13 aa, Artificial Sequence
  Description of Artificial Sequence: Synthetic peptide
AMTWQDYWLYGRK

SEQ ID NO: 5 - protein, 15 aa, Artificial Sequence
  Description of Artificial Sequence: Synthetic peptide
CAMTWQDYWLYGRCK

SEQ ID NO: 6 - protein, 13 aa, Artificial Sequence
  Description of Artificial Sequence: Synthetic peptide
KAMTWQDYWLYGR

SEQ ID NO: 7 - protein, 15 aa, Artificial Sequence
  Description of Artificial Sequence: Synthetic peptide
KCAMTWQDYWLYGRC

SEQ ID NO: 8 - protein, 12 aa, Artificial Sequence
  Description of Artificial Sequence: Synthetic peptide
  MOD_RES (5)..(5): Aib
AMTWXDYWLYGR

SEQ ID NO: 9 - protein, 12 aa, Artificial Sequence
  Description of Artificial Sequence: Synthetic peptide
AMTWQDYWLYGR

SEQ ID NO: 10 - protein, 12 aa, Artificial Sequence
  Description of Artificial Sequence: Synthetic peptide
AMTWQDYWLYGR

SEQ ID NO: 11 - protein, 12 aa, Artificial Sequence
  Description of Artificial Sequence: Synthetic peptide
AATWQDYWLYGR

SEQ ID NO: 12 - protein, 12 aa, Artificial Sequence
  Description of Artificial Sequence: Synthetic peptide
AMAWQDYWLYGR

SEQ ID NO: 13 - protein, 12 aa, Artificial Sequence
  Description of Artificial Sequence: Synthetic peptide
AMTAQDYWLYGR

SEQ ID NO: 14 - protein, 12 aa, Artificial Sequence
  Description of Artificial Sequence: Synthetic peptide
AMTWADYWLYGR

SEQ ID NO: 15 - protein, 12 aa, Artificial Sequence
  Description of Artificial Sequence: Synthetic peptide
AMTWQAYWLYGR

SEQ ID NO: 16 - protein, 14 aa, Artificial Sequence
  Description of Artificial Sequence: Synthetic peptide
  MOD_RES (10)..(10): Cha
  MOD_RES (13)..(13): (2-aminoethoxy)acetic acid
  MOD_RES (14)..(14): D-Lys
CQDWQCYWRXFGXK

SEQ ID NO: 17 - protein, 14 aa, Artificial Sequence
  Description of Artificial Sequence: Synthetic peptide
  MOD_RES (10)..(10): Octgly
  MOD_RES (13)..(13): (2-aminoethoxy)acetic acid
  MOD_RES (14)..(14): D-Lys
CQTWQCYWRGFGXK

SEQ ID NO: 18 - protein, 14 aa, Artificial Sequence
  Description of Artificial Sequence: Synthetic peptide
  MOD_RES (10)..(10): Dap
  MOD_RES (13)..(13): (2-aminoethoxy)acetic acid
  MOD_RES (14)..(14): D-Lys
CQTWQCYWKXFGXK

SEQ ID NO: 19 - protein, 14 aa, Artificial Sequence
  Description of Artificial Sequence: Synthetic peptide
  MOD_RES (10)..(10): Dap
  MOD_RES (13)..(13): (2-aminoethoxy)acetic acid
  MOD_RES (14)..(14): D-Lys
CQTWQCYWHXFGXK

SEQ ID NO: 20 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRLFGXK

SEQ ID NO: 21 - protein, 14 aa, Artificial Sequence
  Description of Artificial Sequence: Synthetic peptide
  MOD_RES (9)..(9): hArg
  MOD_RES (10)..(10): Dap
  MOD_RES (13)..(13): (2-aminoethoxy)acetic acid
  MOD_RES (14)..(14): D-Lys
CQTWQCYWRXFGXK

SEQ ID NO: 22 - protein, 14 aa, Artificial Sequence
  Description of Artificial Sequence: Synthetic peptide
  MOD_RES (9)..(9): Cit
  MOD_RES (10)..(10): Dap
  MOD_RES (13)..(13): (2-aminoethoxy)acetic acid
  MOD_RES (14)..(14): D-Lys
CQTWQCYWXXFGXK

SEQ ID NO: 23 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRVFGXK

SEQ ID NO: 24 - protein, 14 aa, Artificial Sequence
  Description of Artificial Sequence: Synthetic peptide
  MOD_RES (10)..(10): Dap
  MOD_RES (11)..(11): Tic
  MOD_RES (13)..(13): (2-aminoethoxy)acetic acid
  MOD_RES (14)..(14): D-Lys
CQTWQCYWRXXGXK

SEQ ID NO: 25 - protein, 14 aa, Artificial Sequence
  Description of Artificial Sequence: Synthetic peptide
  MOD_RES (8)..(8): Tic
  MOD_RES (9)..(9): Orn
  MOD_RES (13)..(13): (2-aminoethoxy)acetic acid
  MOD_RES (14)..(14): D-Lys
CQTWQCYXXKFGXK

SEQ ID NO: 26 - protein, 14 aa, Artificial Sequence
  Description of Artificial Sequence: Synthetic peptide
  MOD_RES (10)..(10): Dab
  MOD_RES (13)..(13): (2-aminoethoxy)acetic acid
  MOD_RES (14)..(14): D-Lys
CQTWQCYWRXFGXK

SEQ ID NO: 27 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CQTWQCYWXXFGXK

SEQ ID NO: 28 - protein, 14 aa, Artificial Sequence
  Description of Artificial Sequence: Synthetic peptide
  MOD_RES (14)..(14): D-Lys
CQTWQCYWHENGAK

SEQ ID NO: 29 - protein, 14 aa, Artificial Sequence
  Description of Artificial Sequence: Synthetic peptide
  MOD_RES (14)..(14): D-Lys
CRTWQCYWRENGAK

SEQ ID NO: 30 - protein, 14 aa, Artificial Sequence
  Description of Artificial Sequence: Synthetic peptide
  MOD_RES (14)..(14): D-Lys
CRTWQCYWREYGAK

SEQ ID NO: 31 - protein, 14 aa, Artificial Sequence
  Description of Artificial Sequence: Synthetic peptide
  MOD_RES (2)..(2): N-MeAla
  MOD_RES (13)..(13): (2-aminoethoxy)acetic acid
  MOD_RES (14)..(14): D-Lys
CADWVCYWHTFGXK

SEQ ID NO: 32 - protein, 14 aa, Artificial Sequence
  Description of Artificial Sequence: Synthetic peptide
  MOD_RES (13)..(13): Beta-Ala
  MOD_RES (14)..(14): D-Lys
CADWVCYWRKFGAK

SEQ ID NO: 33 - protein, 14 aa, Artificial Sequence
  Description of Artificial Sequence: Synthetic peptide
  MOD_RES (9)..(9): Cit
  MOD_RES (13)..(13): Beta-Ala
  MOD_RES (14)..(14): D-Lys
CADWVCYWXKFGAK

SEQ ID NO: 34 - protein, 14 aa, Artificial Sequence
  Description of Artificial Sequence: Synthetic peptide
  MOD_RES (9)..(9): Cit
  MOD_RES (10)..(10): Tle
  MOD_RES (13)..(13): Beta-Ala
  MOD_RES (14)..(14): D-Lys
CADWVCYWXXFGAK

SEQ ID NO: 35 - protein, 14 aa, Artificial Sequence
  Description of Artificial Sequence: Synthetic peptide
  MOD_RES (9)..(9): Cit
  MOD_RES (10)..(10): t-butyl-Ala
  MOD_RES (13)..(13): Beta-Ala
  MOD_RES (14)..(14): D-Lys
CADWVCYWXAFGAK

SEQ ID NO: 36 - protein, 14 aa, Artificial Sequence
  Description of Artificial Sequence: Synthetic peptide
  MOD_RES (9)..(9): Cit
  MOD_RES (10)..(10): Cha
  MOD_RES (13)..(13): Beta-Ala
  MOD_RES (14)..(14): D-Lys
CADWVCYWXXFGAK

SEQ ID NO: 37 - protein, 14 aa, Artificial Sequence
  Description of Artificial Sequence: Synthetic peptide
  MOD_RES (8)..(8): 1-Nal
  MOD_RES (9)..(9): Cit
  MOD_RES (13)..(13): Beta-Ala
  MOD_RES (14)..(14): D-Lys
CADWVCYXXVFGAK

SEQ ID NO: 38 - protein, 14 aa, Artificial Sequence
  Description of Artificial Sequence: Synthetic peptide
  MOD_RES (9)..(9): Cit
  MOD_RES (13)..(13): Beta-Ala
  MOD_RES (14)..(14): D-Lys
CADWVCYWXVFGAK

SEQ ID NO: 39 - protein, 14 aa, Artificial Sequence
  Description of Artificial Sequence: Synthetic peptide
  MOD_RES (9)..(9): Cit
  MOD_RES (10)..(10): Chg
  MOD_RES (13)..(13): Beta-Ala
  MOD_RES (14)..(14): D-Lys
CADWVCYWXXFGAK

SEQ ID NO: 40 - protein, 14 aa, Artificial Sequence
  Description of Artificial Sequence: Synthetic peptide
  MOD_RES (9)..(9): Cit
  MOD_RES (10)..(10): Beta-Ala
  MOD_RES (13)..(13): Beta-Ala
  MOD_RES (14)..(14): D-Lys
CADWVCYWXAFGAK

SEQ ID NO: 41 - protein, 14 aa, Artificial Sequence
  Description of Artificial Sequence: Synthetic peptide
  MOD_RES (9)..(9): Tle
  MOD_RES (10)..(10): Tle
  MOD_RES (13)..(13): Beta-Ala
  MOD_RES (14)..(14): D-Lys
CADWVCYWXXFGAK

SEQ ID NO: 42 - protein, 14 aa, Artificial Sequence
  Description of Artificial Sequence: Synthetic peptide
  MOD_RES (9)..(9): Tle
  MOD_RES (13)..(13): Beta-Ala
  MOD_RES (14)..(14): D-Lys
CADWVCYWXKFGAK

SEQ ID NO: 43 - protein, 14 aa, Artificial Sequence
  Description of Artificial Sequence: Synthetic peptide
  MOD_RES (9)..(9): D-Ala
  MOD_RES (13)..(13): (2-aminoethoxy)acetic acid
  MOD_RES (14)..(14): D-Lys
CQTWQCYWAVFGXK

SEQ ID NO: 44 - protein, 14 aa, Artificial Sequence
  Description of Artificial Sequence: Synthetic peptide
  MOD_RES (9)..(9): Beta-Ala
  MOD_RES (13)..(13): (2-aminoethoxy)acetic acid
  MOD_RES (14)..(14): D-Lys
CQTWQCYWAVFGXK

SEQ ID NO: 45 - protein, 14 aa, Artificial Sequence
  Description of Artificial Sequence: Synthetic peptide
  MOD_RES (9)..(9): D-Leu
  MOD_RES (13)..(13): (2-aminoethoxy)acetic acid
  MOD_RES (14)..(14): D-Lys
CQTWQCYWLVFGXK

SEQ ID NO: 46 - protein, 14 aa, Artificial Sequence
  Description of Artificial Sequence: Synthetic peptide
  MOD_RES (9)..(9): D-Phe
  MOD_RES (13)..(13): (2-aminoethoxy)acetic acid
  MOD_RES (14)..(14): D-Lys
CQTWQCYWFVFGXK

SEQ ID NO: 47 - protein, 14 aa, Artificial Sequence
  Description of Artificial Sequence: Synthetic peptide
  MOD_RES (9)..(9): D-Asn
  MOD_RES (13)..(13): (2-aminoethoxy)acetic acid
  MOD_RES (14)..(14): D-Lys
CQTWQCYWNVFGXK

SEQ ID NO: 48 - protein, 14 aa, Artificial Sequence
  Description of Artificial Sequence: Synthetic peptide
  MOD_RES (9)..(9): D-Thr
  MOD_RES (13)..(13): (2-aminoethoxy)acetic acid
  MOD_RES (14)..(14): D-Lys
CQTWQCYWTVFGXK

SEQ ID NO: 49 - protein, 14 aa, Artificial Sequence
  Description of Artificial Sequence: Synthetic peptide
  MOD_RES (9)..(9): D-Asp
  MOD_RES (13)..(13): (2-aminoethoxy)acetic acid
  MOD_RES (14)..(14): D-Lys
CQTWQCYWDVFGXK

SEQ ID NO: 50 - protein, 14 aa, Artificial Sequence
  Description of Artificial Sequence: Synthetic peptide
  MOD_RES (9)..(9): Cit
  MOD_RES (10)..(10): D-Leu
  MOD_RES (13)..(13): (2-aminoethoxy)acetic acid
  MOD_RES (14)..(14): D-Lys
CQTWQCYWXLFGXK

SEQ ID NO: 51 - protein, 14 aa, Artificial Sequence
  Description of Artificial Sequence: Synthetic peptide
  MOD_RES (9)..(9): Cit
  MOD_RES (10)..(10): D-Phe
  MOD_RES (13)..(13): (2-aminoethoxy)acetic acid
  MOD_RES (14)..(14): D-Lys
CQTWQCYWXFFGXK

SEQ ID NO: 52 - protein, 14 aa, Artificial Sequence
  Description of Artificial Sequence: Synthetic peptide
  MOD_RES (9)..(9): Cit
  MOD_RES (10)..(10): D-Asn
  MOD_RES (13)..(13): (2-aminoethoxy)acetic acid
  MOD_RES (14)..(14): D-Lys
CQTWQCYWXNFGXK

SEQ ID NO: 53 - protein, 14 aa, Artificial Sequence
  Description of Artificial Sequence: Synthetic peptide
  MOD_RES (9)..(9): Cit
  MOD_RES (10)..(10): D-Thr
  MOD_RES (13)..(13): (2-aminoethoxy)acetic acid
  MOD_RES (14)..(14): D-Lys
CQTWQCYWXTFGXK

SEQ ID NO: 54 - protein, 14 aa, Artificial Sequence
  Description of Artificial Sequence: Synthetic peptide
  MOD_RES (9)..(9): Agp
  MOD_RES (13)..(13): (2-aminoethoxy)acetic acid
  MOD_RES (14)..(14): D-Lys
CQTWQCYWXVNGXK

SEQ ID NO: 55 - protein, 14 aa, Artificial Sequence
  Description of Artificial Sequence: Synthetic peptide
  MOD_RES (8)..(8): alpha-MeTrp
  MOD_RES (13)..(13): (2-aminoethoxy)acetic acid
  MOD_RES (14)..(14): D-Lys
CQTWQCYWRVNGXK

SEQ ID NO: 56 - protein, 14 aa, Artificial Sequence
  Description of Artificial Sequence: Synthetic peptide
  MOD_RES (8)..(8): alpha-MeTrp
  MOD_RES (9)..(9): Cit
  MOD_RES (10)..(10): hLeu
  MOD_RES (13)..(13): (2-aminoethoxy)acetic acid
  MOD_RES (14)..(14): D-Lys
CQTWQCYWXLNGXK

SEQ ID NO: 57 - protein, 14 aa, Artificial Sequence
  Description of Artificial Sequence: Synthetic peptide
  MOD_RES (9)..(9): Cit
  MOD_RES (13)..(13): (2-aminoethoxy)acetic acid
  MOD_RES (14)..(14): D-Lys
CQTWQCYWXVNGXK

SEQ ID NO: 58 - protein, 14 aa, Artificial Sequence
  Description of Artificial Sequence: Synthetic peptide
  MOD_RES (9)..(9): Agp
  MOD_RES (10)..(10): Dap
  MOD_RES (13)..(13): (2-aminoethoxy)acetic acid
  MOD_RES (14)..(14): D-Lys
CQTWQCYWXXNGXK

SEQ ID NO: 59 - protein, 14 aa, Artificial Sequence
  Description of Artificial Sequence: Synthetic peptide
  MOD_RES (9)..(9): Cit
  MOD_RES (12)..(12): D-Ala
  MOD_RES (13)..(13): (2-aminoethoxy)acetic acid
  MOD_RES (14)..(14): D-Lys
CQTWQCYWXVFAXK

SEQ ID NO: 60 - protein, 14 aa, Artificial Sequence
  Description of Artificial Sequence: Synthetic peptide
  MOD_RES (9)..(9): Cit
  MOD_RES (12)..(12): D-Leu
  MOD_RES (13)..(13): (2-aminoethoxy)acetic acid
  MOD_RES (14)..(14): D-Lys
CQTWQCYWXVFLXK

SEQ ID NO: 61 - protein, 14 aa, Artificial Sequence
  Description of Artificial Sequence: Synthetic peptide
  MOD_RES (9)..(9): Cit
  MOD_RES (12)..(12): D-Phe
  MOD_RES (13)..(13): (2-aminoethoxy)acetic acid
  MOD_RES (14)..(14): D-Lys
CQTWQCYWXVFFXK

SEQ ID NO: 62 - protein, 14 aa, Artificial Sequence
  Description of Artificial Sequence: Synthetic peptide
  MOD_RES (9)..(9): Cit
  MOD_RES (12)..(12): D-Asn
  MOD_RES (13)..(13): (2-aminoethoxy)acetic acid
  MOD_RES (14)..(14): D-Lys
CQTWQCYWXVFNXK

SEQ ID NO: 63 - protein, 14 aa, Artificial Sequence
  Description of Artificial Sequence: Synthetic peptide
  MOD_RES (9)..(9): Cit
  MOD_RES (12)..(12): D-Thr
  MOD_RES (13)..(13): (2-aminoethoxy)acetic acid
  MOD_RES (14)..(14): D-Lys
CQTWQCYWXVFTXK

SEQ ID NO: 64 - protein, 14 aa, Artificial Sequence
  Description of Artificial Sequence: Synthetic peptide
  MOD_RES (9)..(9): Cit
  MOD_RES (12)..(12): D-Asp
  MOD_RES (13)..(13): (2-aminoethoxy)acetic acid
  MOD_RES (14)..(14): D-Lys
CQTWQCYWXVFDXK

SEQ ID NO: 65 - protein, 14 aa, Artificial Sequence
  Description of Artificial Sequence: Synthetic peptide
  MOD_RES (2)..(2): N-MeArg
  MOD_RES (13)..(13): (2-aminoethoxy)acetic acid
  MOD_RES (14)..(14): D-Lys
CRTWQCYWRVFGXK

SEQ ID NO: 66 - protein, 14 aa, Artificial Sequence
  Description of Artificial Sequence: Synthetic peptide
  MOD_RES (2)..(2): N-MeGln
  MOD_RES (13)..(13): (2-aminoethoxy)acetic acid
  MOD_RES (14)..(14): D-Lys
CQTWQCYWRVFGXK

SEQ ID NO: 67 - protein, 14 aa, Artificial Sequence
  Description of Artificial Sequence: Synthetic peptide
  MOD_RES (2)..(2): Cit
  MOD_RES (13)..(13): (2-aminoethoxy)acetic acid
  MOD_RES (14)..(14): D-Lys
CXTWQCYWRVFGXK

SEQ ID NO: 68 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYWXXFGXK

SEQ ID NO: 69 - protein, 14 aa, Artificial Sequence
  Description of Artificial Sequence: Synthetic peptide
  MOD_RES (8)..(8): 1-Nal
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYXXXFGXK

SEQ ID NO: 70 - protein, 14 aa, Artificial Sequence
  Description of Artificial Sequence: Synthetic peptide
  MOD_RES (8)..(8): D-Trp
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYWXXFGXK

SEQ ID NO: 71 - protein, 14 aa, Artificial Sequence
  Description of Artificial Sequence: Synthetic peptide
  MOD_RES (8)..(8): hPhe
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYFXXFGXK

SEQ ID NO: 72 - protein, 14 aa, Artificial Sequence
  Description of Artificial Sequence: Synthetic peptide
  MOD_RES (8)..(8): Bip
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYXXXFGXK

SEQ ID NO: 73 - protein, 14 aa, Artificial Sequence
  Description of Artificial Sequence: Synthetic peptide
  MOD_RES (8)..(8): Phe(3,5-F2)
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYFXXFGXK

SEQ ID NO: 74 - protein, 14 aa, Artificial Sequence
  Description of Artificial Sequence: Synthetic peptide
  MOD_RES (8)..(8): Phe(CONH2)
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYFXXFGXK

SEQ ID NO: 75 - protein, 14 aa, Artificial Sequence
  Description of Artificial Sequence: Synthetic peptide
  MOD_RES (8)..(8): Phe(4-CF3)
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYFXXFGXK

SEQ ID NO: 76 - protein, 14 aa, Artificial Sequence
  Description of Artificial Sequence: Synthetic peptide
  MOD_RES (8)..(8): Phe(2,4-Me2)
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYFXXFGXK

SEQ ID NO: 77 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CMTWQCYWLYGRXK

SEQ ID NO: 78 - protein, 14 aa, Artificial Sequence
  Description of Artificial Sequence: Synthetic peptide
  MOD_RES (8)..(8): Beta-hTrp
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYWXXFGXK

SEQ ID NO: 79 - protein, 14 aa, Artificial Sequence
  Description of Artificial Sequence: Synthetic peptide
  MOD_RES (9)..(9): Orn
  MOD_RES (10)..(10): alpha-MeLeu
  MOD_RES (13)..(13): (2-aminoethoxy)acetic acid
  MOD_RES (14)..(14): D-Lys
CADWVCYWXLFGXK

SEQ ID NO: 80 - protein, 14 aa, Artificial Sequence
  Description of Artificial Sequence: Synthetic peptide
  MOD_RES (9)..(9): Orn
  MOD_RES (10)..(10): Beta-spiral-pip
  MOD_RES (13)..(13): (2-aminoethoxy)acetic acid
  MOD_RES (14)..(14): D-Lys
CADWVCYWXXFGXK

SEQ ID NO: 81 - protein, 14 aa, Artificial Sequence
  Description of Artificial Sequence: Synthetic peptide
  MOD_RES (8)..(8): 4-Phenylcyclohexylalanine
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYXXXFGXK

SEQ ID NO: 82 - protein, 14 aa, Artificial Sequence
  Description of Artificial Sequence: Synthetic peptide
  MOD_RES (9)..(9): Orn
  MOD_RES (10)..(10): Aib
  MOD_RES (13)..(13): (2-aminoethoxy)acetic acid
  MOD_RES (14)..(14): D-Lys
CADWVCYWXXFGXK

SEQ ID NO: 83 - protein, 14 aa, Artificial Sequence
  Description of Artificial Sequence: Synthetic peptide
  MOD_RES (9)..(9): Orn
  MOD_RES (10)..(10): Diethyl-Gly
  MOD_RES (13)..(13): (2-aminoethoxy)acetic acid
  MOD_RES (14)..(14): D-Lys
CADWVCYWXGFGXK

SEQ ID NO: 84 - protein, 14 aa, Artificial Sequence
  Description of Artificial Sequence: Synthetic peptide
  MOD_RES (8)..(8): Beta-MePhe(4-F)
  MOD_RES (9)..(9): Orn
  MOD_RES (10)..(10): Dap
  MOD_RES (13)..(13): (2-aminoethoxy)acetic acid
  MOD_RES (14)..(14): D-Lys
CADWVCYFXXFGXK

SEQ ID NO: 85 - protein, 14 aa, Artificial Sequence
  Description of Artificial Sequence: Synthetic peptide
  MOD_RES (8)..(8): Beta-hPhe
  MOD_RES (13)..(13): (2-aminoethoxy)acetic acid
  MOD_RES (14)..(14): D-Lys
CQTWQCYFRVNGXK

SEQ ID NO: 86 - protein, 14 aa, Artificial Sequence
  Description of Artificial Sequence: Synthetic peptide
  MOD_RES (8)..(8): Beta-1-Nal
  MOD_RES (13)..(13): (2-aminoethoxy)acetic acid
  MOD_RES (14)..(14): D-Lys
CQTWQCYXRVNGXK

SEQ ID NO: 87 - protein, 12 aa, Artificial Sequence
  Description of Artificial Sequence: Synthetic peptide
CSDWECYWHIFG

SEQ ID NO: 88 - protein, 12 aa, Artificial Sequence
  Description of Artificial Sequence: Synthetic peptide
CETWECYWHSFS

SEQ ID NO: 89 - protein, 12 aa, Artificial Sequence
  Description of Artificial Sequence: Synthetic peptide
CQSWECYWHYYG

SEQ ID NO: 90 - protein, 12 aa, Artificial Sequence
  Description of Artificial Sequence: Synthetic peptide
CSDWRCYWHVFG

SEQ ID NO: 91 - protein, 12 aa, Artificial Sequence
  Description of Artificial Sequence: Synthetic peptide
CHTWVCYWHEFS

SEQ ID NO: 92 - protein, 12 aa, Artificial Sequence
  Description of Artificial Sequence: Synthetic peptide
CTDWVCYWHEYS

SEQ ID NO: 93 - protein, 12 aa, Artificial Sequence
  Description of Artificial Sequence: Synthetic peptide
CQTWVCYWHTYG

SEQ ID NO: 94 - protein, 12 aa, Artificial Sequence
  Description of Artificial Sequence: Synthetic peptide
CGNWECYWHVYG

SEQ ID NO: 95 - protein, 12 aa, Artificial Sequence
  Description of Artificial Sequence: Synthetic peptide
CKDWKCYWHIYG

SEQ ID NO: 96 - protein, 12 aa, Artificial Sequence
  Description of Artificial Sequence: Synthetic peptide
CRTWVCYWHVFG

SEQ ID NO: 97 - protein, 12 aa, Artificial Sequence
  Description of Artificial Sequence: Synthetic peptide
  MOD_RES (4)..(4): 1-Nal
CADXVCYWHTFG

SEQ ID NO: 98 - protein, 12 aa, Artificial Sequence
  Description of Artificial Sequence: Synthetic peptide
  MOD_RES (4)..(4): 2-Nal
CADXVCYWHTFG

SEQ ID NO: 99 - protein, 12 aa, Artificial Sequence
  Description of Artificial Sequence: Synthetic peptide
  MOD_RES (4)..(4): 1-Bip
CADXVCYWHTFG

SEQ ID NO: 100 - protein, 12 aa, Artificial Sequence
  Description of Artificial Sequence: Synthetic peptide
  MOD_RES (4)..(4): Tic
CADXVCYWHTFG

SEQ ID NO: 101 - protein, 12 aa, Artificial Sequence
  Description of Artificial Sequence: Synthetic peptide
  MOD_RES (4)..(4): Beta-hTrp
CADWVCYWHTFG

SEQ ID NO: 102 - protein, 12 aa, Artificial Sequence
  Description of Artificial Sequence: Synthetic peptide
  MOD_RES (8)..(8): 1-Bip
CADWVCYXHTFG

SEQ ID NO: 103 - protein, 12 aa, Artificial Sequence
  Description of Artificial Sequence: Synthetic peptide
  MOD_RES (8)..(8): Tic
CADWVCYXHTFG

SEQ ID NO: 104 - protein, 12 aa, Artificial Sequence
  Description of Artificial Sequence: Synthetic peptide
  MOD_RES (8)..(8): Beta-hTrp
CADWVCYWHTFG

SEQ ID NO: 105 - protein, 12 aa, Artificial Sequence
  Description of Artificial Sequence: Synthetic peptide
CADWVCYAHTFG

SEQ ID NO: 106 - protein, 12 aa, Artificial Sequence
  Description of Artificial Sequence: Synthetic peptide
ACDWVCYWHTFG

SEQ ID NO: 107 - protein, 12 aa, Artificial Sequence
  Description of Artificial Sequence: Synthetic peptide
ACDWCCYWCTFG

SEQ ID NO: 108 - protein, 12 aa, Artificial Sequence
  Description of Artificial Sequence: Synthetic peptide
AADWCAYWCTFG

SEQ ID NO: 109 - protein, 12 aa, Artificial Sequence
  Description of Artificial Sequence: Synthetic peptide
CADWCCYWCTFG

SEQ ID NO: 110 - protein, 12 aa, Artificial Sequence
  Description of Artificial Sequence: Synthetic peptide
CADWCCYWCTFG

SEQ ID NO: 111 - protein, 12 aa, Artificial Sequence
  Description of Artificial Sequence: Synthetic peptide
CADWCCYWCTFG

SEQ ID NO: 112 - protein, 11 aa, Artificial Sequence
  Description of Artificial Sequence: Synthetic peptide
CADWVCYWHTF

SEQ ID NO: 113 - protein, 10 aa, Artificial Sequence
  Description of Artificial Sequence: Synthetic peptide
CADWVCYWHT

SEQ ID NO: 114 - protein, 8 aa, Artificial Sequence
  Description of Artificial Sequence: Synthetic peptide
CADWVCYW

SEQ ID NO: 115 - protein, 14 aa, Artificial Sequence
  Description of Artificial Sequence: Synthetic peptide
  MOD_RES (1)..(1): Beta-Ala
ASCADWVCYWHTFG

SEQ ID NO: 116 - protein, 14 aa, Artificial Sequence
  Description of Artificial Sequence: Synthetic peptide
  MOD_RES (1)..(1): D-Lys
KSCADWVCYWHTFG

SEQ ID NO: 117 - protein, 14 aa, Artificial Sequence
  Description of Artificial Sequence: Synthetic peptide
  MOD_RES (1)..(1): D-Lys
  MOD_RES (2)..(2): Beta-Ala
KACADWVCYWHTFG

SEQ ID NO: 118 - protein, 13 aa, Artificial Sequence
  Description of Artificial Sequence: Synthetic peptide
  MOD_RES (1)..(1): (2-aminoethoxy)acetic acid
XCADWVCYWHTFG

SEQ ID NO: 119 - protein, 13 aa, Artificial Sequence
  Description of Artificial Sequence: Synthetic peptide
  MOD_RES (1)..(1): D-Lys
KCADWVCYWHTFG

SEQ ID NO: 120 - protein, 12 aa, Artificial Sequence
  Description of Artificial Sequence: Synthetic peptide
CKDWVCYWHTFG

SEQ ID NO: 121 - protein, 12 aa, Artificial Sequence
  Description of Artificial Sequence: Synthetic peptide
CADWKCYWHTFG

SEQ ID NO: 122 - protein, 12 aa, Artificial Sequence
  Description of Artificial Sequence: Synthetic peptide
CADWVCYWKTFG

SEQ ID NO: 123 - protein, 12 aa, Artificial Sequence
  Description of Artificial Sequence: Synthetic peptide
CADWVCYWHKFG

SEQ ID NO: 124 - protein, 12 aa, Artificial Sequence
  Description of Artificial Sequence: Synthetic peptide
CADWVCYWHTKG

SEQ ID NO: 125 - protein, 12 aa, Artificial Sequence
  Description of Artificial Sequence: Synthetic peptide
  MOD_RES (12)..(12): D-Lys
CADWVCYWHTFK

SEQ ID NO: 126 - protein, 12 aa, Artificial Sequence
  Description of Artificial Sequence: Synthetic peptide
CADWVCYWHTFG

SEQ ID NO: 127 - protein, 11 aa, Artificial Sequence
  Description of Artificial Sequence: Synthetic peptide
  MOD_RES (8)..(8): 1-Nal
CADWVCYXHTF

SEQ ID NO: 128 - protein, 11 aa, Artificial Sequence
  Description of Artificial Sequence: Synthetic peptide
  MOD_RES (8)..(8): 1-Nal
  MOD_RES (11)..(11): N-Me-Phe
CADWVCYXHTF

SEQ ID NO: 129 - protein, 11 aa, Artificial Sequence
  Description of Artificial Sequence: Synthetic peptide
  MOD_RES (8)..(8): 1-Nal
  MOD_RES (10)..(10): Sarc
CADWVCYXHXF

SEQ ID NO: 130 - protein, 11 aa, Artificial Sequence
  Description of Artificial Sequence: Synthetic peptide
  MOD_RES (8)..(8): 1-Nal
  MOD_RES (9)..(9): N-Me-His
CADWVCYXHTF

SEQ ID NO: 131 - protein, 13 aa, Artificial Sequence
  Description of Artificial Sequence: Synthetic peptide
CADWVCYWHTFGK

SEQ ID NO: 132 - protein, 11 aa, Artificial Sequence
  Description of Artificial Sequence: Synthetic peptide
  MOD_RES (2)..(2): Sarc
  MOD_RES (8)..(8): 1-Nal
CXDWVCYXHTF

SEQ ID NO: 133 - protein, 11 aa, Artificial Sequence
  Description of Artificial Sequence: Synthetic peptide
  MOD_RES (4)..(4): N-Me-Trp
  MOD_RES (8)..(8): 1-Nal
CADWVCYXHTF

SEQ ID NO: 134 - protein, 11 aa, Artificial Sequence
  Description of Artificial Sequence: Synthetic peptide
  MOD_RES (5)..(5): Sarc
  MOD_RES (8)..(8): 1-Nal
CADWXCYXHTF

SEQ ID NO: 135 - protein, 11 aa, Artificial Sequence
  Description of Artificial Sequence: Synthetic peptide
  MOD_RES (8)..(8): 1-Nal
  MOD_RES (11)..(11): D-Phe
CADWVCYXHTF

SEQ ID NO: 136 - protein, 12 aa, Artificial Sequence
  Description of Artificial Sequence: Synthetic peptide
  MOD_RES (8)..(8): 1-Nal
  MOD_RES (12)..(12): Sarc
CADWVCYXHTFX

SEQ ID NO: 137 - protein, 12 aa, Artificial Sequence
  Description of Artificial Sequence: Synthetic peptide
CATWVCYWHTFG

SEQ ID NO: 138 - protein, 12 aa, Artificial Sequence
  Description of Artificial Sequence: Synthetic peptide
CADWECYWHTFG

SEQ ID NO: 139 - protein, 16 aa, Artificial Sequence
  Description of Artificial Sequence: Synthetic peptide
CADWVCYWHRCGWWGC

SEQ ID NO: 140 - protein, 12 aa, Artificial Sequence
  Description of Artificial Sequence: Synthetic peptide
  MOD_RES (8)..(8): 1-Nal
  MOD_RES (10)..(10): D-Ala
CADWVCYXHAFG

SEQ ID NO: 141 - protein, 12 aa, Artificial Sequence
  Description of Artificial Sequence: Synthetic peptide
  MOD_RES (8)..(8): 1-Nal
  MOD_RES (10)..(10): Aib
CADWVCYXHXFG

SEQ ID NO: 142 - protein, 12 aa, Artificial Sequence
  Description of Artificial Sequence: Synthetic peptide
  MOD_RES (8)..(8): 1-Nal
  MOD_RES (10)..(10): beta-Ala
CADWVCYXHAFG

SEQ ID NO: 143 - protein, 12 aa, Artificial Sequence
  Description of Artificial Sequence: Synthetic peptide
  MOD_RES (8)..(8): 1-Nal
CADWVCYXFTFG

SEQ ID NO: 144 - protein, 12 aa, Artificial Sequence
  Description of Artificial Sequence: Synthetic peptide
  MOD_RES (8)..(8): 1-Nal
  MOD_RES (9)..(9): D-Ala
CADWVCYXATFG

SEQ ID NO: 145 - protein, 12 aa, Artificial Sequence
  Description of Artificial Sequence: Synthetic peptide
  MOD_RES (8)..(8): 1-Nal
  MOD_RES (10)..(10): Aib
  MOD_RES (11)..(11): D-Phe
CADWVCYXHXFG

SEQ ID NO: 146 - protein, 12 aa, Artificial Sequence
  Description of Artificial Sequence: Synthetic peptide
  MOD_RES (8)..(8): 1-Nal
  MOD_RES (12)..(12): Aib
CADWVCYXHTFX

SEQ ID NO: 147 - protein, 12 aa, Artificial Sequence
  Description of Artificial Sequence: Synthetic peptide
  MOD_RES (8)..(8): 1-Nal
  MOD_RES (9)..(9): N-Me-His
  MOD_RES (10)..(10): D-Ala
  MOD_RES (12)..(12): Aib
CADWVCYXHAFX

SEQ ID NO: 148 - protein, 11 aa, Artificial Sequence
  Description of Artificial Sequence: Synthetic peptide
  MOD_RES (8)..(8): 1-Nal
  MOD_RES (10)..(10): AEP
CADWVCYXHXG

SEQ ID NO: 149 - protein, 14 aa, Artificial Sequence
  Description of Artificial Sequence: Synthetic peptide
  MOD_RES (9)..(9): N-MeHis
  MOD_RES (13)..(13): (2-aminoethoxy)acetic acid
  MOD_RES (14)..(14): D-Lys
CADWVCYWHTFGXK

SEQ ID NO: 150 - protein, 14 aa, Artificial Sequence
  Description of Artificial Sequence: Synthetic peptide
  MOD_RES (8)..(8): Aic
  MOD_RES (13)..(13): (2-aminoethoxy)acetic acid
  MOD_RES (14)..(14): D-Lys
CADWVCYXHTFGXK

SEQ ID NO: 151 - protein, 14 aa, Artificial Sequence
  Description of Artificial Sequence: Synthetic peptide
  MOD_RES (8)..(8): Bip
  MOD_RES (13)..(13): (2-aminoethoxy)acetic acid
  MOD_RES (14)..(14): D-Lys
CADWVCYXHTFGXK

SEQ ID NO: 152 - protein, 14 aa, Artificial Sequence
  Description of Artificial Sequence: Synthetic peptide
  MOD_RES (9)..(9): N-MeArg
  MOD_RES (13)..(13): (2-aminoethoxy)acetic acid
  MOD_RES (14)..(14): D-Lys
CQTWQCYWRENGXK

SEQ ID NO: 153 - protein, 14 aa, Artificial Sequence
  Description of Artificial Sequence: Synthetic peptide
  MOD_RES (10)..(10): N-MeArg
  MOD_RES (13)..(13): (2-aminoethoxy)acetic acid
  MOD_RES (14)..(14): D-Lys
CQTWQCYWRRNGXK

SEQ ID NO: 154 - protein, 14 aa, Artificial Sequence
  Description of Artificial Sequence: Synthetic peptide
  MOD_RES (10)..(10): N-MeLys
  MOD_RES (13)..(13): (2-aminoethoxy)acetic acid
  MOD_RES (14)..(14): D-Lys
CQTWQCYWRKNGXK

SEQ ID NO: 155 - protein, 14 aa, Artificial Sequence
  Description of Artificial Sequence: Synthetic peptide
  MOD_RES (10)..(10): Sarc
  MOD_RES (13)..(13): (2-aminoethoxy)acetic acid
  MOD_RES (14)..(14): D-Lys
CQTWQCYWRXNGXK

SEQ ID NO: 156 - protein, 14 aa, Artificial Sequence
  Description of Artificial Sequence: Synthetic peptide
  MOD_RES (10)..(10): D-Glu
  MOD_RES (13)..(13): (2-aminoethoxy)acetic acid
  MOD_RES (14)..(14): D-Lys
CQTWQCYWRENGXK

SEQ ID NO: 157 - protein, 14 aa, Artificial Sequence
  Description of Artificial Sequence: Synthetic peptide
  MOD_RES (9)..(9): D-Arg
  MOD_RES (13)..(13): (2-aminoethoxy)acetic acid
  MOD_RES (14)..(14): D-Lys
CQTWQCYWRENGXK

SEQ ID NO: 158 - protein, 14 aa, Artificial Sequence
  Description of Artificial Sequence: Synthetic peptide
  MOD_RES (9)..(9): D-Arg
  MOD_RES (10)..(10): D-Glu
  MOD_RES (13)..(13): (2-aminoethoxy)acetic acid
  MOD_RES (14)..(14): D-Lys
CQTWQCYWRENGXK

SEQ ID NO: 159 - protein, 13 aa, Artificial Sequence
  Description of Artificial Sequence: Synthetic peptide
  MOD_RES (9)..(9): N-MeGlu
  MOD_RES (12)..(12): (2-aminoethoxy)acetic acid
  MOD_RES (13)..(13): D-Lys
CQTWQCYWENGXK

SEQ ID NO: 160 - protein, 6 aa, Artificial Sequence
  Description of Artificial Sequence: Synthetic peptide
CADWVC

SEQ ID NO: 161 - protein, 14 aa, Artificial Sequence
  Description of Artificial Sequence: Synthetic peptide
  MOD_RES (9)..(9): N-MeArg
  MOD_RES (13)..(13): AEP
  MOD_RES (14)..(14): D-Lys
CRDWQCYWRKFGXK

SEQ ID NO: 162 - protein, 14 aa, Artificial Sequence
  Description of Artificial Sequence: Synthetic peptide
  MOD_RES (10)..(10): D-Lys
  MOD_RES (13)..(13): AEP
  MOD_RES (14)..(14): D-Lys
CRDWQCYWRKFGXK

SEQ ID NO: 163 - protein, 14 aa, Artificial Sequence
  Description of Artificial Sequence: Synthetic peptide
  MOD_RES (9)..(9): D-Arg
  MOD_RES (13)..(13): AEP
  MOD_RES (14)..(14): D-Lys
CRDWQCYWRKFGXK

SEQ ID NO: 164 - protein, 14 aa, Artificial Sequence
  Description of Artificial Sequence: Synthetic peptide
  MOD_RES (9)..(9): D-Arg
  MOD_RES (10)..(10): D-Lys
  MOD_RES (13)..(13): AEP
  MOD_RES (14)..(14): D-Lys
CRDWQCYWRKFGXK

SEQ ID NO: 165 - protein, 14 aa, Artificial Sequence
  Description of Artificial Sequence: Synthetic peptide
  MOD_RES (9)..(9): N-MeArg
  MOD_RES (13)..(13): (2-aminoethoxy)acetic acid
  MOD_RES (14)..(14): D-Lys
CQTWQCYWRENGXK

SEQ ID NO: 166 - protein, 12 aa, Artificial Sequence
  Description of Artificial Sequence: Synthetic peptide
CTDWKCYWHEFG

SEQ ID NO: 167 - protein, 12 aa, Artificial Sequence
  Description of Artificial Sequence: Synthetic peptide
CRTWTCYWHVYG

SEQ ID NO: 168 - protein, 12 aa, Artificial Sequence
  Description of Artificial Sequence: Synthetic peptide
CPNWECYWHRFG

SEQ ID NO: 169 - protein, 12 aa, Artificial Sequence
  Description of Artificial Sequence: Synthetic peptide
CADWVCYWHTFG

SEQ ID NO: 170 - protein, 12 aa, Artificial Sequence
  Description of Artificial Sequence: Synthetic peptide
CADWMCYWHEYG

SEQ ID NO: 171 - protein, 12 aa, Artificial Sequence
  Description of Artificial Sequence: Synthetic peptide
CTTWKCYWHQYG

SEQ ID NO: 172 - protein, 12 aa, Artificial Sequence
  Description of Artificial Sequence: Synthetic peptide
CSNWECYWHHYG

SEQ ID NO: 173 - protein, 12 aa, Artificial Sequence
  Description of Artificial Sequence: Synthetic peptide
CSDWVCYWHVYG

SEQ ID NO: 174 - protein, 12 aa, Artificial Sequence
  Description of Artificial Sequence: Synthetic peptide
CDTWKCYWHRQS

SEQ ID NO: 175 - protein, 12 aa, Artificial Sequence
  Description of Artificial Sequence: Synthetic peptide
  MOD_RES (8)..(8): 1-Nal
CADWVCYXHTFG

SEQ ID NO: 176 - protein, 12 aa, Artificial Sequence
  Description of Artificial Sequence: Synthetic peptide
  MOD_RES (8)..(8): 2-Nal
CADWVCYXHTFG

SEQ ID NO: 177 - protein, 12 aa, Artificial Sequence
  Description of Artificial Sequence: Synthetic peptide
CADWVCYWHTFG

SEQ ID NO: 178 - protein, 13 aa, Artificial Sequence
  Description of Artificial Sequence: Synthetic peptide
  MOD_RES (13)..(13): D-Lys
CADWVCYWHTFGK

SEQ ID NO: 179 - protein, 15 aa, Artificial Sequence
  Description of Artificial Sequence: Synthetic peptide
  MOD_RES (15)..(15): D-Lys
CADWVCYWHTFGAPK

SEQ ID NO: 180 - protein, 12 aa, Artificial Sequence
  Description of Artificial Sequence: Synthetic peptide
CTDWKCYWHTFG

SEQ ID NO: 181 - protein, 12 aa, Artificial Sequence
  Description of Artificial Sequence: Synthetic peptide
CRDWVCYWHTFG

SEQ ID NO: 182 - protein, 12 aa, Artificial Sequence
  Description of Artificial Sequence: Synthetic peptide
CADWVCYWHEFG

SEQ ID NO: 183 - protein, 16 aa, Artificial Sequence
  Description of Artificial Sequence: Synthetic peptide
CADWVCYWHFHQLRDA

SEQ ID NO: 184 - protein, 16 aa, Artificial Sequence
  Description of Artificial Sequence: Synthetic peptide
CADWVCYWHEHSERVG

SEQ ID NO: 185 - protein, 16 aa, Artificial Sequence
  Description of Artificial Sequence: Synthetic peptide
CADWVCYWHNHSEGSG

SEQ ID NO: 186 - protein, 16 aa, Artificial Sequence
  Description of Artificial Sequence: Synthetic peptide
CADWVCYWHRSTGGQH

SEQ ID NO: 187 - protein, 15 aa, Artificial Sequence
  Description of Artificial Sequence: Synthetic peptide
  MOD_RES (1)..(1): D-Lys
  MOD_RES (9)..(9): 1-Nal
  MOD_RES (13)..(13): Sarc
  MOD_RES (14)..(14): AEP
  MOD_RES (15)..(15): D-Arg
KCRDWQCYXHTHXXR

SEQ ID NO: 188 - protein, 16 aa, Artificial Sequence
  Description of Artificial Sequence: Synthetic peptide
TQFDCRTWECYWHTFG

SEQ ID NO: 189 - protein, 16 aa, Artificial Sequence
  Description of Artificial Sequence: Synthetic peptide
GGVECNDWQCYWHTFG

SEQ ID NO: 190 - protein, 16 aa, Artificial Sequence
  Description of Artificial Sequence: Synthetic peptide
REGTCSTWKCYWHTFG

SEQ ID NO: 191 - protein, 16 aa, Artificial Sequence
  Description of Artificial Sequence: Synthetic peptide
DTPRCRTWECYWHTFG

SEQ ID NO: 192 - protein, 16 aa, Artificial Sequence
  Description of Artificial Sequence: Synthetic peptide
GGGECENWECYWHTFG

SEQ ID NO: 193 - protein, 16 aa, Artificial Sequence
  Description of Artificial Sequence: Synthetic peptide
GDHKCSSWECYWHTFG

SEQ ID NO: 194 - protein, 16 aa, Artificial Sequence
  Description of Artificial Sequence: Synthetic peptide
GSVHCMTWECYWHTFG

SEQ ID NO: 195 - protein, 12 aa, Artificial Sequence
  Description of Artificial Sequence: Synthetic peptide
  MOD_RES (8)..(8): 1-Nal
CADWVCYXVTFG

SEQ ID NO: 196 - protein, 14 aa, Artificial Sequence
  Description of Artificial Sequence: Synthetic peptide
  MOD_RES (9)..(9): D-His
  MOD_RES (13)..(13): (2-aminoethoxy)acetic acid
  MOD_RES (14)..(14): D-Lys
CADWVCYWHTFGXK

SEQ ID NO: 197 - protein, 12 aa, Artificial Sequence
  Description of Artificial Sequence: Synthetic peptide
CRDWQCYWHKFG

SEQ ID NO: 198 - protein, 12 aa, Artificial Sequence
  Description of Artificial Sequence: Synthetic peptide
CSNWVCYWHTYG

SEQ ID NO: 199 - protein, 14 aa, Artificial Sequence
  Description of Artificial Sequence: Synthetic peptide
  MOD_RES (13)..(13): Beta-Ala
  MOD_RES (14)..(14): D-Lys
CADWVCYWHTFGAK

SEQ ID NO: 200 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CADWVCYWHTFGXK

SEQ ID NO: 201 - protein, 12 aa, Artificial Sequence
  Description of Artificial Sequence: Synthetic peptide
CADWVCYWHTFG

SEQ ID NO: 202 - protein, 14 aa, Artificial Sequence
  Description of Artificial Sequence: Synthetic peptide
  MOD_RES (13)..(13): AEP
  MOD_RES (14)..(14): D-Arg
CADWVCYWHTFGXR

SEQ ID NO: 203 - protein, 14 aa, Artificial Sequence
  Description of Artificial Sequence: Synthetic peptide
  MOD_RES (13)..(13): AEP
CADWVCYWHTFGXK

SEQ ID NO: 204 - protein, 14 aa, Artificial Sequence
  Description of Artificial Sequence: Synthetic peptide
  MOD_RES (13)..(13): Gaba
  MOD_RES (14)..(14): D-Lys
CADWVCYWHTFGXK

SEQ ID NO: 205 - protein, 13 aa, Artificial Sequence
  Description of Artificial Sequence: Synthetic peptide
  MOD_RES (13)..(13): Hexanoic-D-Lys
CADWVCYWHTFGK

SEQ ID NO: 206 - protein, 13 aa, Artificial Sequence
  Description of Artificial Sequence: Synthetic peptide
  MOD_RES (13)..(13): (PEG)2-D-Lys
CADWVCYWHTFGK

SEQ ID NO: 207 - protein, 14 aa, Artificial Sequence
  Description of Artificial Sequence: Synthetic peptide
  MOD_RES (14)..(14): D-Lys
CADWVCYWHTFGPK

SEQ ID NO: 208 - protein, 14 aa, Artificial Sequence
  Description of Artificial Sequence: Synthetic peptide
  MOD_RES (13)..(13): Azt
  MOD_RES (14)..(14): D-Lys
CADWVCYWHTFGXK

SEQ ID NO: 209 - protein, 14 aa, Artificial Sequence
  Description of Artificial Sequence: Synthetic peptide
  MOD_RES (14)..(14): D-Lys
CADWVCYWHTFGAK

SEQ ID NO: 210 - protein, 15 aa, Artificial Sequence
  Description of Artificial Sequence: Synthetic peptide
  MOD_RES (15)..(15): D-Lys
CADWVCYWHTFGAPK

SEQ ID NO: 211 - protein, 15 aa, Artificial Sequence
  Description of Artificial Sequence: Synthetic peptide
  MOD_RES (14)..(14): Azt
  MOD_RES (15)..(15): D-Lys
CADWVCYWHTFGAXK

SEQ ID NO: 212 - protein, 15 aa, Artificial Sequence
  Description of Artificial Sequence: Synthetic peptide
  MOD_RES (15)..(15): D-Lys
CADWVCYWHTFGAAK

SEQ ID NO: 213 - protein, 14 aa, Artificial Sequence
  Description of Artificial Sequence: Synthetic peptide
  MOD_RES (13)..(13): AEP
  MOD_RES (14)..(14): D-Lys
CRDWQCYWHKFGXK

SEQ ID NO: 214 - protein, 12 aa, Artificial Sequence
  Description of Artificial Sequence: Synthetic peptide
CATWQCYWHEYG

SEQ ID NO: 215 - protein, 12 aa, Artificial Sequence
  Description of Artificial Sequence: Synthetic peptide
CKTWTCYWHEFG

SEQ ID NO: 216 - protein, 12 aa, Artificial Sequence
  Description of Artificial Sequence: Synthetic peptide
CTTWTCYWHQYG

SEQ ID NO: 217 - protein, 12 aa, Artificial Sequence
  Description of Artificial Sequence: Synthetic peptide
CRTWECYWHEFG

SEQ ID NO: 218 - protein, 12 aa, Artificial Sequence
  Description of Artificial Sequence: Synthetic peptide
CRTWQCYWHEYG

SEQ ID NO: 219 - protein, 12 aa, Artificial Sequence
  Description of Artificial Sequence: Synthetic peptide
CQTWQCYWRENG

SEQ ID NO: 220 - protein, 12 aa, Artificial Sequence
  Description of Artificial Sequence: Synthetic peptide
CRTWECYWHEYG

SEQ ID NO: 221 - protein, 12 aa, Artificial Sequence
  Description of Artificial Sequence: Synthetic peptide
CTTWECYWHEYG

SEQ ID NO: 222 - protein, 12 aa, Artificial Sequence
  Description of Artificial Sequence: Synthetic peptide
CRTWECYWHEQS

SEQ ID NO: 223 - protein, 12 aa, Artificial Sequence
  Description of Artificial Sequence: Synthetic peptide
CTTWECYWHQFG

SEQ ID NO: 224 - protein, 12 aa, Artificial Sequence
  Description of Artificial Sequence: Synthetic peptide
CTTWECYWHEFG

SEQ ID NO: 225 - protein, 12 aa, Artificial Sequence
  Description of Artificial Sequence: Synthetic peptide
CQTWECYWHLYG

SEQ ID NO: 226 - protein, 12 aa, Artificial Sequence
  Description of Artificial Sequence: Synthetic peptide
CEDWKCYWHKYG

SEQ ID NO: 227 - protein, 12 aa, Artificial Sequence
  Description of Artificial Sequence: Synthetic peptide
CTDWVCYWHTFG

SEQ ID NO: 228 - protein, 12 aa, Artificial Sequence
  Description of Artificial Sequence: Synthetic peptide
CADWVCYWHTYG

SEQ ID NO: 229 - protein, 16 aa, Artificial Sequence
  Description of Artificial Sequence: Synthetic peptide
CADWVCYWHRHADRVK

SEQ ID NO: 230 - protein, 14 aa, Artificial Sequence
  Description of Artificial Sequence: Synthetic peptide
CADWVCYWHTFGER

SEQ ID NO: 231 - protein, 14 aa, Artificial Sequence
  Description of Artificial Sequence: Synthetic peptide
CADWVCYWHTHGER

SEQ ID NO: 232 - protein, 16 aa, Artificial Sequence
  Description of Artificial Sequence: Synthetic peptide
DTPRCRTWECYWHTFG

SEQ ID NO: 233 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWVCYWRENGXK

SEQ ID NO: 234 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRENGXK

SEQ ID NO: 235 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRTNGXK

SEQ ID NO: 236 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRKNGXK

SEQ ID NO: 237 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRRNGXK

SEQ ID NO: 238 - protein, 14 aa, Artificial Sequence
  Description of Artificial Sequence: Synthetic peptide
  MOD_RES (10)..(10): Dapa
  MOD_RES (13)..(13): (2-aminoethoxy)acetic acid
  MOD_RES (14)..(14): D-Lys
CQTWQCYWRXNGXK

SEQ ID NO: 239 - protein, 14 aa, Artificial Sequence
  Description of Artificial Sequence: Synthetic peptide
  MOD_RES (10)..(10): Orn
  MOD_RES (13)..(13): (2-aminoethoxy)acetic acid
  MOD_RES (14)..(14): D-Lys
CQTWQCYWRXNGXK

SEQ ID NO: 240 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CRTWQCYWRKFGXK

SEQ ID NO: 241 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Arg
CQTWQCYWRENGXR

SEQ ID NO: 242 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRENGXK

SEQ ID NO: 243 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQDWQCYWRENGXK

SEQ ID NO: 244 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRENGXK

SEQ ID NO: 245 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRTNGXK

SEQ ID NO: 246 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWVCYWRENGXK

SEQ ID NO: 247 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRKNGXK

SEQ ID NO: 248 - protein, 12 aa, Artificial Sequence
  Description of Artificial Sequence: Synthetic peptide
  MOD_RES (9)..(9): Cav
CQTWQCYWXENG

SEQ ID NO: 249 - protein, 12 aa, Artificial Sequence
  Description of Artificial Sequence: Synthetic peptide
  MOD_RES (9)..(9): Cpa
CQTWQCYWXENG

SEQ ID NO: 250 - protein, 12 aa, Artificial Sequence
  Description of Artificial Sequence: Synthetic peptide
CQTWQCYWLENG

SEQ ID NO: 251 - protein, 12 aa, Artificial Sequence
  Description of Artificial Sequence: Synthetic peptide
  MOD_RES (9)..(9): hLeu
CQTWQCYWLENG

SEQ ID NO: 252 - protein, 12 aa, Artificial Sequence
  Description of Artificial Sequence: Synthetic peptide
  MOD_RES (10)..(10): Lys-Ac
CQTWQCYWRKNG

SEQ ID NO: 253 - protein, 12 aa, Artificial Sequence
  Description of Artificial Sequence: Synthetic peptide
CRTWQCYWRKFG

SEQ ID NO: 254 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-Me-Lys
XQTWQXFXKENG

SEQ ID NO: 255 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XNTWQXFXXKNN

SEQ ID NO: 256 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Lys(Ac)
XQTWQXFXLKNN

SEQ ID NO: 257 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 258 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 259 - protein, 12 aa, Artificial Sequence
  Description of Artificial Sequence: Synthetic peptide
  MOD_RES (1)..(1): Abu
  MOD_RES (7)..(7): Phe(4-(2-aminoethoxy))
  MOD_RES (9)..(9): alpha-MeLys
XQTWQCFWKENG

SEQ ID NO: 260 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): 4-amino-4-carboxy-tetrahydropyran
XQTWQCFXXENN

SEQ ID NO: 261 - protein, 20 aa, Mus sp.
NWQPWSSPFVHQTSQETGKR

SEQ ID NO: 262 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 263 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 264 - protein, 8 aa, Artificial Sequence
  Description of Artificial Sequence: Synthetic peptide
  MOD_RES (2)..(2): Any amino acid
  MOD_RES (3)..(3): Any amino acid
  MOD_RES (5)..(5): Any amino acid
CXXWXCYW

SEQ ID NO: 265 - protein, 4 aa, Artificial Sequence
  Description of Artificial Sequence: Synthetic peptide
  MOD_RES (1)..(1): alpha-MeLys
KENG

SEQ ID NO: 266 - protein, 4 aa, Artificial Sequence
  Description of Artificial Sequence: Synthetic peptide
  MOD_RES (1)..(1): alpha-MeLys
  MOD_RES (2)..(2): Lys(Ac)
KKNN

SEQ ID NO: 267 - protein, 4 aa, Artificial Sequence
  Description of Artificial Sequence: Synthetic peptide
  MOD_RES (1)..(1): alpha-MeLeu
  MOD_RES (2)..(2): Lys(Ac)
LKNN

SEQ ID NO: 268 - protein, 4 aa, Artificial Sequence
  Description of Artificial Sequence: Synthetic peptide
  MOD_RES (1)..(1): alpha-MeLeu
LENG

SEQ ID NO: 269 - protein, 4 aa, Artificial Sequence
  Description of Artificial Sequence: Synthetic peptide
  MOD_RES (1)..(1): alpha-MeLeu
LENG

SEQ ID NO: 270 - protein, 4 aa, Artificial Sequence
  Description of Artificial Sequence: Synthetic peptide
  MOD_RES (1)..(1): alpha-MeLys
KENN

SEQ ID NO: 271 - protein, 6 aa, Artificial Sequence
  Description of Artificial Sequence: Synthetic peptide
  MOD_RES (5)..(5): 2-Nal
  MOD_RES (6)..(6): alpha-MeLys
WQCYXK

SEQ ID NO: 272 - protein, 6 aa, Artificial Sequence
  Description of Artificial Sequence: Synthetic peptide
  MOD_RES (4)..(4): Phe(4-OMe)
  MOD_RES (5)..(5): 2-Nal
  MOD_RES (6)..(6): alpha-MeLys
WQCFXK

SEQ ID NO: 273 - protein, 6 aa, Artificial Sequence
  Description of Artificial Sequence: Synthetic peptide
  MOD_RES (4)..(4): Phe(4-OMe)
  MOD_RES (5)..(5): 2-Nal
  MOD_RES (6)..(6): Aib
WQCFXX

SEQ ID NO: 274 - protein, 6 aa, Artificial Sequence
  Description of Artificial Sequence: Synthetic peptide
  MOD_RES (3)..(3): Pen
  MOD_RES (4)..(4): Phe(4-OMe)
  MOD_RES (5)..(5): 2-Nal
  MOD_RES (6)..(6): alpha-MeLys
WQXFXK

SEQ ID NO: 275 - protein, 14 aa, Artificial Sequence
  Description of Artificial Sequence: Synthetic peptide
  MOD_RES (2)..(2): Any amino acid
  MOD_RES (3)..(3): Any amino acid
  MOD_RES (5)..(5): Any amino acid
  MOD_RES (10)..(10): Any amino acid
  MOD_RES (12)..(12): Any amino acid
  MOD_RES (13)..(13): Any amino acid
  MOD_RES (14)..(14): D-Lys
CXXWXCYWHXFXXK

SEQ ID NO: 276 - protein, 12 aa, Artificial Sequence
  Description of Artificial Sequence: Synthetic peptide
  MOD_RES (1)..(1): Abu
  MOD_RES (7)..(7): Tyr(OMe)
  MOD_RES (8)..(8): 2-Nal
  MOD_RES (9)..(9): alpha-MeLys
XQTWQCYXKENG

SEQ ID NO: 277 - protein, 12 aa, Artificial Sequence
  Description of Artificial Sequence: Synthetic peptide
FPTWEWYWCNRD

SEQ ID NO: 278 - protein, 12 aa, Artificial Sequence
  Description of Artificial Sequence: Synthetic peptide
ALTWEFYWLCRE

SEQ ID NO: 279 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Tyr(OMe)
  MOD_RES (8)..(8): 2-Nal
  MOD_RES (9)..(9): alpha-MeLys
XQTWQXYXKENG

SEQ ID NO: 280 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
XQTWQCFWKENG

SEQ ID NO: 281 - protein, 12 aa, Artificial Sequence
  Description of Artificial Sequence: Synthetic peptide
KMTWQDYWLYGR

SEQ ID NO: 282 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-Me-Lys
XQTWQXFXKENG

SEQ ID NO: 283 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XNTWQXFXXKNN

SEQ ID NO: 284 - protein, 12 aa, Artificial Sequence
  Description of Artificial Sequence: Synthetic peptide
AMTWQDYWLYGK

SEQ ID NO: 285 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Lys(Ac)
XQTWQXFXLKNN

SEQ ID NO: 286 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 287-290 - skipped (4 entries)

SEQ ID NO: 291 - protein, 14 aa, Artificial Sequence
  Description of Artificial Sequence: Synthetic peptide
  MOD_RES (1)..(1): Beta-Ala
ASCADWVCYWHTFG

SEQ ID NO: 292 - protein, 14 aa, Artificial Sequence
  Description of Artificial Sequence: Synthetic peptide
  MOD_RES (1)..(1): D-Lys
KSCADWVCYWHTFG

SEQ ID NO: 293 - protein, 14 aa, Artificial Sequence
  Description of Artificial Sequence: Synthetic peptide
  MOD_RES (1)..(1): D-Lys
  MOD_RES (2)..(2): Beta-Ala
KACADWVCYWHTFG

SEQ ID NO: 294 - protein, 13 aa, Artificial Sequence
  Description of Artificial Sequence: Synthetic peptide
  MOD_RES (1)..(1): (2-aminoethoxy)acetic acid
XCADWVCYWHTFG

SEQ ID NO: 295 - protein, 13 aa, Artificial Sequence
  Description of Artificial Sequence: Synthetic peptide
  MOD_RES (1)..(1): D-Lys
KCADWVCYWHTFG

SEQ ID NO: 296 - protein, 12 aa, Artificial Sequence
  Description of Artificial Sequence: Synthetic peptide
CKDWVCYWHTFG

SEQ ID NO: 297 - protein, 12 aa, Artificial Sequence
  Description of Artificial Sequence: Synthetic peptide
CADWKCYWHTFG

SEQ ID NO: 298 - protein, 12 aa, Artificial Sequence
  Description of Artificial Sequence: Synthetic peptide
CADWVCYWKTFG

SEQ ID NO: 299 - protein, 12 aa, Artificial Sequence
  Description of Artificial Sequence: Synthetic peptide
CADWVCYWHKFG

SEQ ID NO: 300 - protein, 12 aa, Artificial Sequence
  Description of Artificial Sequence: Synthetic peptide
CADWVCYWHTKG

SEQ ID NO: 301 - protein, 13 aa, Artificial Sequence
  Description of Artificial Sequence: Synthetic peptide
CADWVCYWHTFDK

SEQ ID NO: 302 - protein, 14 aa, Artificial Sequence
  Description of Artificial Sequence: Synthetic peptide
CADWVCYWHTFGDK

SEQ ID NO: 303 - protein, 14 aa, Artificial Sequence
  Description of Artificial Sequence: Synthetic peptide
  MOD_RES (13)..(13): Beta-Ala
  MOD_RES (14)..(14): D-Lys
CADWVCYWHTFGAK

SEQ ID NO: 304 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CADWVCYWHTFGXK

SEQ ID NO: 305 - protein, 13 aa, Artificial Sequence
  Description of Artificial Sequence: Synthetic peptide
CADWVCYWHTFGK

SEQ ID NO: 306 - protein, 14 aa, Artificial Sequence
  Description of Artificial Sequence: Synthetic peptide
  MOD_RES (1)..(1): Beta-Ala
ASCADWVCYWHTFG

SEQ ID NO: 307 - protein, 14 aa, Artificial Sequence
  Description of Artificial Sequence: Synthetic peptide
  MOD_RES (1)..(1): D-Lys
KSCADWVCYWHTFG

SEQ ID NO: 308 - protein, 14 aa, Artificial Sequence
  Description of Artificial Sequence: Synthetic peptide
  MOD_RES (1)..(1): D-Lys
  MOD_RES (2)..(2): Beta-Ala
KACADWVCYWHTFG

SEQ ID NO: 309 - protein, 13 aa, Artificial Sequence
  Description of Artificial Sequence: Synthetic peptide
  MOD_RES (1)..(1): (2-aminoethoxy)acetic acid
XCADWVCYWHTFG

SEQ ID NO: 310 - protein, 13 aa, Artificial Sequence
  Description of Artificial Sequence: Synthetic peptide
  MOD_RES (1)..(1): D-Lys
KCADWVCYWHTFG

SEQ ID NO: 311 - protein, 12 aa, Artificial Sequence
  Description of Artificial Sequence: Synthetic peptide
CKDWVCYWHTFG

SEQ ID NO: 312 - protein, 12 aa, Artificial Sequence
  Description of Artificial Sequence: Synthetic peptide
CADWKCYWHTFG

SEQ ID NO: 313 - protein, 12 aa, Artificial Sequence
  Description of Artificial Sequence: Synthetic peptide
CADWVCYWKTFG

SEQ ID NO: 314 - protein, 12 aa, Artificial Sequence
  Description of Artificial Sequence: Synthetic peptide
CADWVCYWHKFG

SEQ ID NO: 315 - protein, 12 aa, Artificial Sequence
  Description of Artificial Sequence: Synthetic peptide
CADWVCYWHTKG

SEQ ID NO: 316 - protein, 12 aa, Artificial Sequence
  Description of Artificial Sequence: Synthetic peptide
  MOD_RES (12)..(12): D-Lys
CADWVCYWHTFK

SEQ ID NO: 317 - protein, 13 aa, Artificial Sequence
  Description of Artificial Sequence: Synthetic peptide
  MOD_RES (13)..(13): D-Lys
CADWVCYWHTFGK

SEQ ID NO: 318 - protein, 14 aa, Artificial Sequence
  Description of Artificial Sequence: Synthetic peptide
  MOD_RES (13)..(13): Beta-Ala
  MOD_RES (14)..(14): D-Lys
CADWVCYWHTFGAK

SEQ ID NO: 319 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CADWVCYWHTFGXK

SEQ ID NO: 320 - protein, 13 aa, Artificial Sequence
  Description of Artificial Sequence: Synthetic peptide
CADWVCYWHTFGK

SEQ ID NO: 321 - protein, 14 aa, Artificial Sequence
  Description of Artificial Sequence: Synthetic peptide
  MOD_RES (8)..(8): Beta-hTyr
  MOD_RES (13)..(13): (2-aminoethoxy)acetic acid
  MOD_RES (14)..(14): D-Lys
CQTWQCYYRVNGXK

SEQ ID NO: 322 - protein, 14 aa, Artificial Sequence
  Description of Artificial Sequence: Synthetic peptide
  MOD_RES (8)..(8): Beta-hPhe(4-F)
  MOD_RES (13)..(13): (2-aminoethoxy)acetic acid
  MOD_RES (14)..(14): D-Lys
CQTWQCYFRVNGXK

SEQ ID NO: 323 - protein, 14 aa, Artificial Sequence
  Description of Artificial Sequence: Synthetic peptide
  MOD_RES (8)..(8): Beta-Nva(5-Phenyl)
  MOD_RES (13)..(13): (2-aminoethoxy)acetic acid
  MOD_RES (14)..(14): D-Lys
CQTWQCYXRVNGXK

SEQ ID NO: 324 - protein, 14 aa, Artificial Sequence
  Description of Artificial Sequence: Synthetic peptide
  MOD_RES (8)..(8): Phe(3,4-Cl2)
  MOD_RES (13)..(13): (2-aminoethoxy)acetic acid
  MOD_RES (14)..(14): D-Lys
CQTWQCYFRVNGXK

SEQ ID NO: 325 - protein, 14 aa, Artificial Sequence
  Description of Artificial Sequence: Synthetic peptide
  MOD_RES (8)..(8): Tqa
  MOD_RES (13)..(13): (2-aminoethoxy)acetic acid
  MOD_RES (14)..(14): D-Lys
CQTWQCYXRVNGXK

SEQ ID NO: 326 - protein, 14 aa, Artificial Sequence
  Description of Artificial Sequence: Synthetic peptide
  MOD_RES (10)..(10): Beta-hLeu
  MOD_RES (13)..(13): (2-aminoethoxy)acetic acid
  MOD_RES (14)..(14): D-Lys
CQTWQCYWRLNGXK

SEQ ID NO: 327 - protein, 14 aa, Artificial Sequence
  Description of Artificial Sequence: Synthetic peptide
  MOD_RES (10)..(10): Aib
  MOD_RES (13)..(13): (2-aminoethoxy)acetic acid
  MOD_RES (14)..(14): D-Lys
CQTWQCYWRXNGXK

SEQ ID NO: 328 - protein, 14 aa, Artificial Sequence
  Description of Artificial Sequence: Synthetic peptide
  MOD_RES (10)..(10): Beta-hAla
  MOD_RES (13)..(13): (2-aminoethoxy)acetic acid
  MOD_RES (14)..(14): D-Lys
CQTWQCYWRANGXK

SEQ ID NO: 329 - protein, 14 aa, Artificial Sequence
  Description of Artificial Sequence: Synthetic peptide
  MOD_RES (10)..(10): Beta-hVal
  MOD_RES (13)..(13): (2-aminoethoxy)acetic acid
  MOD_RES (14)..(14): D-Lys
CQTWQCYWRVNGXK

SEQ ID NO: 330 - protein, 14 aa, Artificial Sequence
  Description of Artificial Sequence: Synthetic peptide
  MOD_RES (10)..(10): Beta-spiral-pip
  MOD_RES (13)..(13): (2-aminoethoxy)acetic acid
  MOD_RES (14)..(14): D-Lys
CQTWQCYWRXNGXK

SEQ ID NO: 331 - protein, 14 aa, Artificial Sequence
  Description of Artificial Sequence: Synthetic peptide
  MOD_RES (10)..(10): Beta-Glu
  MOD_RES (13)..(13): (2-aminoethoxy)acetic acid
  MOD_RES (14)..(14): D-Lys
CQTWQCYWRENGXK

SEQ ID NO: 332 - protein, 14 aa, Artificial Sequence
  Description of Artificial Sequence: Synthetic peptide
  MOD_RES (9)..(9): Beta-hLeu
  MOD_RES (13)..(13): (2-aminoethoxy)acetic acid
  MOD_RES (14)..(14): D-Lys
CQTWQCYWLVNGXK

SEQ ID NO: 333 - protein, 14 aa, Artificial Sequence
  Description of Artificial Sequence: Synthetic peptide
  MOD_RES (9)..(9): Beta-Aib
  MOD_RES (13)..(13): (2-aminoethoxy)acetic acid
  MOD_RES (14)..(14): D-Lys
CQTWQCYWXVNGXK

SEQ ID NO: 334 - protein, 14 aa, Artificial Sequence
  Description of Artificial Sequence: Synthetic peptide
  MOD_RES (9)..(9): Beta-hAla
  MOD_RES (13)..(13): (2-aminoethoxy)acetic acid
  MOD_RES (14)..(14): D-Lys
CQTWQCYWAVNGXK

SEQ ID NO: 335 - protein, 14 aa, Artificial Sequence
  Description of Artificial Sequence: Synthetic peptide
  MOD_RES (9)..(9): Beta-hVal
  MOD_RES (13)..(13): (2-aminoethoxy)acetic acid
  MOD_RES (14)..(14): D-Lys
CQTWQCYWVVNGXK

SEQ ID NO: 336 - protein, 14 aa, Artificial Sequence
  Description of Artificial Sequence: Synthetic peptide
  MOD_RES (9)..(9): Beta-spiral-pip
  MOD_RES (13)..(13): (2-aminoethoxy)acetic acid
  MOD_RES (14)..(14): D-Lys
CQTWQCYWXVNGXK

SEQ ID NO: 337 - protein, 14 aa, Artificial Sequence
  Description of Artificial Sequence: Synthetic peptide
  MOD_RES (9)..(9): Beta-hArg
  MOD_RES (13)..(13): (2-aminoethoxy)acetic acid
  MOD_RES (14)..(14): D-Lys
CQTWQCYWRVNGXK

SEQ ID NO: 338 - protein, 14 aa, Artificial Sequence
  Description of Artificial Sequence: Synthetic peptide
  MOD_RES (6)..(6): MeCys
  MOD_RES (13)..(13): (2-aminoethoxy)acetic acid
  MOD_RES (14)..(14): D-Lys
MRTWQCYWRKFGXK

SEQ ID NO: 339 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
ACDWVCYWRKFGXK

SEQ ID NO: 340 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
SRTWQSYWRKFGXK

SEQ ID NO: 341 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
CDWVCYWRKFGXK

SEQ ID NO: 342 - protein, 14 aa, Artificial Sequence
  Description of Artificial Sequence: Synthetic peptide
  MOD_RES (6)..(6): MeCys
  MOD_RES (13)..(13): (2-aminoethoxy)acetic acid
  MOD_RES (14)..(14): D-Lys
ARTWQCYWRKFGXK

SEQ ID NO: 343 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
ARTWQAYWRKFGXK

SEQ ID NO: 344 - protein, 13 aa, Artificial Sequence
  Description of Artificial Sequence: Synthetic peptide
  MOD_RES (9)..(9): hLeu
  MOD_RES (12)..(12): (2-aminoethoxy)acetic acid
  MOD_RES (13)..(13): D-Lys
CQTWQCYWLENXK

SEQ ID NO: 345 - protein, 14 aa, Artificial Sequence
  Description of Artificial Sequence: Synthetic peptide
  MOD_RES (9)..(9): hLeu
  MOD_RES (13)..(13): (2-aminoethoxy)acetic acid
  MOD_RES (14)..(14): D-Lys
CQTWQCYWLENGXK

SEQ ID NO: 346 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CSTWECYWRVYGXK

SEQ ID NO: 347 - protein, 14 aa, Artificial Sequence
  Description of Artificial Sequence: Synthetic peptide
  MOD_RES (2)..(2): Orn
  MOD_RES (13)..(13): (2-aminoethoxy)acetic acid
  MOD_RES (14)..(14): D-Lys
CXTWQCYWRVFGXK

SEQ ID NO: 348 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CQTWQCYWXXFGXK

SEQ ID NO: 349 - protein, 14 aa, Artificial Sequence
  Description of Artificial Sequence: Synthetic peptide
  MOD_RES (2)..(2): N-MeAsn
  MOD_RES (13)..(13): (2-aminoethoxy)acetic acid
  MOD_RES (14)..(14): D-Lys
CNTWQCYWRVFGXK

SEQ ID NO: 350 - protein, 14 aa, Artificial Sequence
  Description of Artificial Sequence: Synthetic peptide
  MOD_RES (2)..(2): N-MeLys
  MOD_RES (13)..(13): (2-aminoethoxy)acetic acid
  MOD_RES (14)..(14): D-Lys
CKTWQCYWRVFGXK

SEQ ID NO: 351 - protein, 14 aa, Artificial Sequence
  Description of Artificial Sequence: Synthetic peptide
  MOD_RES (2)..(2): Dab
  MOD_RES (13)..(13): (2-aminoethoxy)acetic acid
  MOD_RES (14)..(14): D-Lys
CXTWQCYWRVFGXK

SEQ ID NO: 352 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CQTWQCYYXXFGXK

SEQ ID NO: 353 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CSTWQCYWXXYGXK

SEQ ID NO: 354 - protein, 14 aa, Artificial Sequence
  Description of Artificial Sequence: Synthetic peptide
  MOD_RES (9)..(9): Cit
  MOD_RES (10)..(10): Dap
  MOD_RES (13)..(13): (2-aminoethoxy)acetic acid
  MOD_RES (14)..(14): D-Lys
CSTWECYWXXYGXK

SEQ ID NO: 355 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CQTWQCFFXXFGXK

SEQ ID NO: 356 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CPTWQCYWRVFGXK

SEQ ID NO: 357 - protein, 14 aa, Artificial Sequence
  Description of Artificial Sequence: Synthetic peptide
  MOD_RES (9)..(9): Orn
  MOD_RES (10)..(10): Dab
  MOD_RES (13)..(13): (2-aminoethoxy)acetic acid
  MOD_RES (14)..(14): D-Lys
CSTWECYWXXYGXK

SEQ ID NO: 358 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CSTWECYWRVFGXK

SEQ ID NO: 359 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CLTWQCYWRVFGXK

SEQ ID NO: 360 - protein, 14 aa, Artificial Sequence
  Description of Artificial Sequence: Synthetic peptide
  MOD_RES (9)..(9): Orn
  MOD_RES (10)..(10): Dap
  MOD_RES (13)..(13): (2-aminoethoxy)acetic acid
  MOD_RES (14)..(14): D-Lys
CQTWQCYFXXFGXK

SEQ ID NO: 361 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CNTWQCYWRVFGXK

SEQ ID NO: 362 - protein, 14 aa, Artificial Sequence
  Description of Artificial Sequence: Synthetic peptide
  MOD_RES (2)..(2): Dap
  MOD_RES (13)..(13): (2-aminoethoxy)acetic acid
  MOD_RES (14)..(14): D-Lys
CXTWQCYWRVFGXK

SEQ ID NO: 363 - protein, 14 aa, Artificial Sequence
  Description of Artificial Sequence: Synthetic peptide
  MOD_RES (2)..(2): N-Me-Ala
  MOD_RES (13)..(13): (2-aminoethoxy)acetic acid
  MOD_RES (14)..(14): D-Lys
CATWQCYWRVFGXK

SEQ ID NO: 364 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CKTWQCYWRVFGXK

SEQ ID NO: 365 - protein, 14 aa, Artificial Sequence
  Description of Artificial Sequence: Synthetic peptide
  MOD_RES (10)..(10): Cha
  MOD_RES (13)..(13): (2-aminoethoxy)acetic acid
  MOD_RES (14)..(14): D-Lys
CQDWQCYWRXFGXK

SEQ ID NO: 366 - protein, 14 aa, Artificial Sequence
  Description of Artificial Sequence: Synthetic peptide
  MOD_RES (10)..(10): Ogl
  MOD_RES (13)..(13): (2-aminoethoxy)acetic acid
  MOD_RES (14)..(14): D-Lys
CQTWQCYWRXFGXK

SEQ ID NO: 367 - protein, 14 aa, Artificial Sequence
  Description of Artificial Sequence: Synthetic peptide
  MOD_RES (10)..(10): Dap
  MOD_RES (13)..(13): (2-aminoethoxy)acetic acid
  MOD_RES (14)..(14): D-Lys
CQTWQCYWKXFGXK

SEQ ID NO: 368 - protein, 14 aa, Artificial Sequence
  Description of Artificial Sequence: Synthetic peptide
  MOD_RES (10)..(10): Dap
  MOD_RES (13)..(13): (2-aminoethoxy)acetic acid
  MOD_RES (14)..(14): D-Lys
CQTWQCYWHXFGXK

SEQ ID NO: 369 - protein, 14 aa, Artificial Sequence
  Description of Artificial Sequence: Synthetic peptide
  MOD_RES (13)..(13): (2-aminoethoxy)acetic acid
  MOD_RES (14)..(14): D-Lys
CQTWQCYWRLFGXK

SEQ ID NO: 370 - protein, 14 aa, Artificial Sequence
  Description of Artificial Sequence: Synthetic peptide
  MOD_RES (9)..(9): hArg
  MOD_RES (10)..(10): Dap
  MOD_RES (13)..(13): (2-aminoethoxy)acetic acid
  MOD_RES (14)..(14): D-Lys
CQTWQCYWRXFGXK

SEQ ID NO: 371 - protein, 12 aa, Artificial Sequence
  Description of Artificial Sequence: Synthetic peptide
CSTWECYWRTFG

SEQ ID NO: 372 - protein, 12 aa, Artificial Sequence
  Description of Artificial Sequence: Synthetic peptide
CDSWECYWRTYG

SEQ ID NO: 373 - protein, 12 aa, Artificial Sequence
  Description of Artificial Sequence: Synthetic peptide
CSTWECYWHTYG

SEQ ID NO: 374 - protein, 12 aa, Artificial Sequence
  Description of Artificial Sequence: Synthetic peptide
CKTWTCYWHTYG

SEQ ID NO: 375 - protein, 12 aa, Artificial Sequence
  Description of Artificial Sequence: Synthetic peptide
CRTWECYWHEYS

SEQ ID NO: 376 - protein, 12 aa, Artificial Sequence
  Description of Artificial Sequence: Synthetic peptide
CRTWTCYWHEYG

SEQ ID NO: 377 - protein, 12 aa, Artificial Sequence
  Description of Artificial Sequence: Synthetic peptide
CFTWQCYWHEYS

SEQ ID NO: 378 - protein, 12 aa, Artificial Sequence
  Description of Artificial Sequence: Synthetic peptide
  MOD_RES (9)..(9): 3-Pal
CQTWQCYWXENG

SEQ ID NO: 379 - protein, 6 aa, Artificial Sequence
  Description of Artificial Sequence: Synthetic peptide
CQTWQC

SEQ ID NO: 380 - protein, 6 aa, Artificial Sequence
  Description of Artificial Sequence: Synthetic peptide
CRTWQC

SEQ ID NO: 381 - protein, 7 aa, Artificial Sequence
  Description of Artificial Sequence: Synthetic peptide
CADWVCY

SEQ ID NO: 382 - protein, 8 aa, Artificial Sequence
  Description of Artificial Sequence: Synthetic peptide
CADWVCYW

SEQ ID NO: 383 - protein, 9 aa, Artificial Sequence
  Description of Artificial Sequence: Synthetic peptide
CADWVCYWH

SEQ ID NO: 384 - protein, 10 aa, Artificial Sequence
  Description of Artificial Sequence: Synthetic peptide
CADWVCYWHT

SEQ ID NO: 385 - protein, 11 aa, Artificial Sequence
  Description of Artificial Sequence: Synthetic peptide
CADWVCYWHTF

SEQ ID NO: 386 - protein, 12 aa, Artificial Sequence
  Description of Artificial Sequence: Synthetic peptide
CMTWQCYWLYGR

SEQ ID NO: 387 - protein, 12 aa, Artificial Sequence
  Description of Artificial Sequence: Synthetic peptide
CRTWQCYWHEFG

SEQ ID NO: 388 - protein, 12 aa, Artificial Sequence
  Description of Artificial Sequence: Synthetic peptide
CRTWECYWHTFG

SEQ ID NO: 389 - protein, 12 aa, Artificial Sequence
  Description of Artificial Sequence: Synthetic peptide
CQTWQCYWHEFG

SEQ ID NO: 390 - protein, 14 aa, Artificial Sequence
  Description of Artificial Sequence: Synthetic peptide
CRTWQCYWQQFGGE

SEQ ID NO: 391 - protein, 14 aa, Artificial Sequence
  Description of Artificial Sequence: Synthetic peptide
CRSWQCYWLNFGPD

SEQ ID NO: 392 - protein, 14 aa, Artificial Sequence
  Description of Artificial Sequence: Synthetic peptide
CRTWQCYWLKMGDS

SEQ ID NO: 393 - protein, 14 aa, Artificial Sequence
  Description of Artificial Sequence: Synthetic peptide
CQTWQCYWIKRDQG

SEQ ID NO: 394 - protein, 14 aa, Artificial Sequence
  Description of Artificial Sequence: Synthetic peptide
CSTWQCYWLKHGGE

SEQ ID NO: 395 - protein, 14 aa, Artificial Sequence
  Description of Artificial Sequence: Synthetic peptide
CSTWECYWSQRADQ

SEQ ID NO: 396 - protein, 14 aa, Artificial Sequence
  Description of Artificial Sequence: Synthetic peptide
CQTWECYWRTFGPS

SEQ ID NO: 397 - protein, 14 aa, Artificial Sequence
  Description of Artificial Sequence: Synthetic peptide
CRTWQCYWQEKGTD

SEQ ID NO: 398 - protein, 14 aa, Artificial Sequence
  Description of Artificial Sequence: Synthetic peptide
CQTWQCYWLDSLGD

SEQ ID NO: 399 - protein, 15 aa, Artificial Sequence
  Description of Artificial Sequence: Synthetic peptide
CRTWQCYWTKFGSEP

SEQ ID NO: 400 - protein, 12 aa, Artificial Sequence
  Description of Artificial Sequence: Synthetic peptide
  MOD_RES (9)..(9): hLeu
CQTWQCYWLEPG

SEQ ID NO: 401 - protein, 12 aa, Artificial Sequence
  Description of Artificial Sequence: Synthetic peptide
  MOD_RES (9)..(9): hLeu
CQTWQCYWLELG

SEQ ID NO: 402 - protein, 12 aa, Artificial Sequence
  Description of Artificial Sequence: Synthetic peptide
  MOD_RES (9)..(9): hLeu
CQTWQCYWLETG

SEQ ID NO: 403 - protein, 12 aa, Artificial Sequence
  Description of Artificial Sequence: Synthetic peptide
  MOD_RES (9)..(9): hLeu
CQTWQCYWLFNG

SEQ ID NO: 404 - protein, 12 aa, Artificial Sequence
  Description of Artificial Sequence: Synthetic peptide
  MOD_RES (9)..(9): hLeu
CQTWQCYWLPNG

SEQ ID NO: 405 - protein, 12 aa, Artificial Sequence
  Description of Artificial Sequence: Synthetic peptide
  MOD_RES (9)..(9): hLeu
CQTWQCYWLNNG

SEQ ID NO: 406 - protein, 12 aa, Artificial Sequence
  Description of Artificial Sequence: Synthetic peptide
  MOD_RES (9)..(9): hLeu
CQTWQCYWLLNG

SEQ ID NO: 407 - protein, 12 aa, Artificial Sequence
  Description of Artificial Sequence: Synthetic peptide
  MOD_RES (9)..(9): hLeu
CQTWQCYWLTNG

SEQ ID NO: 408 - protein, 12 aa, Artificial Sequence
  Description of Artificial Sequence: Synthetic peptide
CQTWQCYWFENG

SEQ ID NO: 409 - protein, 12 aa, Artificial Sequence
  Description of Artificial Sequence: Synthetic peptide
CQTWQCYWPENG

SEQ ID NO: 410 - protein, 12 aa, Artificial Sequence
  Description of Artificial Sequence: Synthetic peptide
CQTWQCYWQENG

SEQ ID NO: 411 - protein, 12 aa, Artificial Sequence
  Description of Artificial Sequence: Synthetic peptide
CQTWQCYWTENG

SEQ ID NO: 412 - protein, 12 aa, Artificial Sequence
  Description of Artificial Sequence: Synthetic peptide
CQTWQCYWEENG

SEQ ID NO: 413 - protein, 12 aa, Artificial Sequence
  Description of Artificial Sequence: Synthetic peptide
  MOD_RES (9)..(9): hLeu
CQTWFCYWLENG

SEQ ID NO: 414 - protein, 12 aa, Artificial Sequence
  Description of Artificial Sequence: Synthetic peptide
  MOD_RES (9)..(9): hLeu
CQTWPCYWLENG

SEQ ID NO: 415 - protein, 12 aa, Artificial Sequence
  Description of Artificial Sequence: Synthetic peptide
  MOD_RES (9)..(9): hLeu
CQTWNCYWLENG

SEQ ID NO: 416 - protein, 12 aa, Artificial Sequence
  Description of Artificial Sequence: Synthetic peptide
  MOD_RES (9)..(9): hLeu
CQTWRCYWLENG

SEQ ID NO: 417 - protein, 12 aa, Artificial Sequence
  Description of Artificial Sequence: Synthetic peptide
  MOD_RES (9)..(9): hLeu
CQTWTCYWLENG

SEQ ID NO: 418 - protein, 12 aa, Artificial Sequence
  Description of Artificial Sequence: Synthetic peptide
  MOD_RES (9)..(9): hLeu
CQTWECYWLENG

SEQ ID NO: 419 - protein, 12 aa, Artificial Sequence
  Description of Artificial Sequence: Synthetic peptide
  MOD_RES (9)..(9): hLeu
CQTGQCYWLENG

SEQ ID NO: 420 - protein, 12 aa, Artificial Sequence
  Description of Artificial Sequence: Synthetic peptide
  MOD_RES (9)..(9): hLeu
CQTPQCYWLENG

SEQ ID NO: 421 - protein, 12 aa, Artificial Sequence
  Description of Artificial Sequence: Synthetic peptide
  MOD_RES (9)..(9): hLeu
CQTNQCYWLENG

SEQ ID NO: 422 - protein, 12 aa, Artificial Sequence
  Description of Artificial Sequence: Synthetic peptide
  MOD_RES (9)..(9): hLeu
CQTRQCYWLENG

SEQ ID NO: 423 - protein, 12 aa, Artificial Sequence
  Description of Artificial Sequence: Synthetic peptide
  MOD_RES (9)..(9): hLeu
CQTTQCYWLENG

SEQ ID NO: 424 - protein, 12 aa, Artificial Sequence
  Description of Artificial Sequence: Synthetic peptide
  MOD_RES (9)..(9): hLeu
CQTEQCYWLENG

SEQ ID NO: 425 - protein, 12 aa, Artificial Sequence
  Description of Artificial Sequence: Synthetic peptide
  MOD_RES (9)..(9): hLeu
CQFWQCYWLENG

SEQ ID NO: 426 - protein, 12 aa, Artificial Sequence
  Description of Artificial Sequence: Synthetic peptide
  MOD_RES (9)..(9): hLeu
CQPWQCYWLENG

SEQ ID NO: 427 - protein, 12 aa, Artificial Sequence
  Description of Artificial Sequence: Synthetic peptide
  MOD_RES (9)..(9): hLeu
CQNWQCYWLENG

SEQ ID NO: 428 - protein, 12 aa, Artificial Sequence
  Description of Artificial Sequence: Synthetic peptide
  MOD_RES (9)..(9): hLeu
CQRWQCYWLENG

SEQ ID NO: 429 - protein, 12 aa, Artificial Sequence
  Description of Artificial Sequence: Synthetic peptide
  MOD_RES (9)..(9): hLeu
CQEWQCYWLENG

SEQ ID NO: 430 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 431 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeOrn
XQTWQCFXXENG

SEQ ID NO: 432 - protein, 12 aa, Artificial Sequence
  Description of Artificial Sequence: Synthetic peptide
  MOD_RES (1)..(1): Abu
  MOD_RES (7)..(7): Phe(4-CO2H)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 433 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 434 - protein, 12 aa, Artificial Sequence
  Description of Artificial Sequence: Synthetic peptide
  MOD_RES (1)..(1): Abu
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 435 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNA

SEQ ID NO: 436 - protein, 13 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNAE

SEQ ID NO: 437 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKENG

SEQ ID NO: 438 - protein, 12 aa, Artificial Sequence
  Description of Artificial Sequence: Synthetic peptide
  MOD_RES (1)..(1): Abu
  MOD_RES (7)..(7): Phe(4-(2-aminoethoxy))
  MOD_RES (9)..(9): alpha-MeLys
XQTWQCFWKENG

SEQ ID NO: 439 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKDNG

SEQ ID NO: 440 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(succinic acid)
XQTWQCFXKKNG

SEQ ID NO: 441 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(glutaric acid)
XQTWQCFXKKNG

SEQ ID NO: 442 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(pyroglutamic acid) conjugated through side chain
XQTWQCFXKKNG

SEQ ID NO: 443 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(isovaleric acid)
XQTWQCFXKKNG

SEQ ID NO: 444 - protein, 13 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (13)..(13): D-Lys
XQTWQCFXKKNGK

SEQ ID NO: 445 - protein, 13 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (13)..(13): (2-aminoethoxy)acetic acid
XQTWQCFXKKNGX

SEQ ID NO: 446 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
XQTWQCFXXQNG

SEQ ID NO: 447 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQCFXXKNA

SEQ ID NO: 448 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
XQTWQCFXXKNG

SEQ ID NO: 449 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 450 - protein, 12 aa, Artificial Sequence
  Description of Artificial Sequence: Synthetic peptide
  MOD_RES (9)..(9): hLeu
CFTWQCYWLENG

SEQ ID NO: 451 - protein, 12 aa, Artificial Sequence
  Description of Artificial Sequence: Synthetic peptide
  MOD_RES (9)..(9): hLeu
CPTWQCYWLENG

SEQ ID NO: 452 - protein, 12 aa, Artificial Sequence
  Description of Artificial Sequence: Synthetic peptide
  MOD_RES (9)..(9): hLeu
CNTWQCYWLENG

SEQ ID NO: 453 - protein, 12 aa, Artificial Sequence
  Description of Artificial Sequence: Synthetic peptide
  MOD_RES (9)..(9): hLeu
CGTWQCYWLENG

SEQ ID NO: 454 - protein, 12 aa, Artificial Sequence
  Description of Artificial Sequence: Synthetic peptide
  MOD_RES (9)..(9): hLeu
CTTWQCYWLENG

SEQ ID NO: 455 - protein, 12 aa, Artificial Sequence
  Description of Artificial Sequence: Synthetic peptide
  MOD_RES (9)..(9): hLeu
CETWQCYWLENG

SEQ ID NO: 456 - protein, 12 aa, Artificial Sequence
  Description of Artificial Sequence: Synthetic peptide
  MOD_RES (9)..(9): N-MeLeu
CQTWQCYWLENG

SEQ ID NO: 457 - protein, 12 aa, Artificial Sequence
  Description of Artificial Sequence: Synthetic peptide
  MOD_RES (9)..(9): alpha-MeOrn
CQTWQCYWXENG

SEQ ID NO: 458 - protein, 12 aa, Artificial Sequence
  Description of Artificial Sequence: Synthetic peptide
  MOD_RES (9)..(9): alpha-MeOrn
CQTWQCYWXENG

SEQ ID NO: 459 - protein, 12 aa, Artificial Sequence
  Description of Artificial Sequence: Synthetic peptide
  MOD_RES (7)..(7): alpha-MePhe
  MOD_RES (9)..(9): hLeu
CQTWQCFWLENG

SEQ ID NO: 460 - protein, 12 aa, Artificial Sequence
  Description of Artificial Sequence: Synthetic peptide
  MOD_RES (9)..(9): Aib
CQTWQCYWXENG

SEQ ID NO: 461 - protein, 12 aa, Artificial Sequence
  Description of Artificial Sequence: Synthetic peptide
  MOD_RES (7)..(7): hTyr
  MOD_RES (9)..(9): hLeu
CQTWQCYWLENG

SEQ ID NO: 462 - protein, 12 aa, Artificial Sequence
  Description of Artificial Sequence: Synthetic peptide
  MOD_RES (7)..(7): Bip
  MOD_RES (9)..(9): hLeu
CQTWQCXWLENG

SEQ ID NO: 463 - protein, 12 aa, Artificial Sequence
  Description of Artificial Sequence: Synthetic peptide
  MOD_RES (9)..(9): Ogl
CQTWQCYWXENG

SEQ ID NO: 464 - protein, 12 aa, Artificial Sequence
  Description of Artificial Sequence: Synthetic peptide
  MOD_RES (9)..(9): hLeu
  MOD_RES (10)..(10): Lys(Ac)
CQTWQCYWLKNG

SEQ ID NO: 465 - protein, 13 aa, Artificial Sequence
  Description of Artificial Sequence: Synthetic peptide
  MOD_RES (9)..(9): hLeu
CQTWQCYWLENGG

SEQ ID NO: 466 - protein, 13 aa, Artificial Sequence
  Description of Artificial Sequence: Synthetic peptide
  MOD_RES (9)..(9): hLeu
CQTWQCYWLENGP

SEQ ID NO: 467 - protein, 13 aa, Artificial Sequence
  Description of Artificial Sequence: Synthetic peptide
  MOD_RES (9)..(9): hLeu
CQTWQCYWLENGE

SEQ ID NO: 468 - protein, 13 aa, Artificial Sequence
  Description of Artificial Sequence: Synthetic peptide
  MOD_RES (9)..(9): hLeu
  MOD_RES (13)..(13): D-Glu
CQTWQCYWLENGE

SEQ ID NO: 469 - protein, 12 aa, Artificial Sequence
  Description of Artificial Sequence: Synthetic peptide
  MOD_RES (8)..(8): alpha-MePhe
  MOD_RES (9)..(9): hLeu
CQTWQCYFLENG

SEQ ID NO: 470 - protein, 13 aa, Artificial Sequence
  Description of Artificial Sequence: Synthetic peptide
  MOD_RES (9)..(9): hLeu
CQTWQCYWLENGP

SEQ ID NO: 471 - protein, 13 aa, Artificial Sequence
  Description of Artificial Sequence: Synthetic peptide
  MOD_RES (9)..(9): hLeu
CQTWQCYWLENGG

SEQ ID NO: 472 - protein, 13 aa, Artificial Sequence
  Description of Artificial Sequence: Synthetic peptide
  MOD_RES (9)..(9): hLeu
CQTWQCYWLENGL

SEQ ID NO: 473 - protein, 13 aa, Artificial Sequence
  Description of Artificial Sequence: Synthetic peptide
  MOD_RES (9)..(9): hLeu
CQTWQCYWLENGF

SEQ ID NO: 474 - protein, 13 aa, Artificial Sequence
  Description of Artificial Sequence: Synthetic peptide
  MOD_RES (9)..(9): hLeu
CQTWQCYWLENGE

SEQ ID NO: 475 - protein, 13 aa, Artificial Sequence
  Description of Artificial Sequence: Synthetic peptide
  MOD_RES (9)..(9): hLeu
CQTWQCYWLENGN

SEQ ID NO: 476 - protein, 13 aa, Artificial Sequence
  Description of Artificial Sequence: Synthetic peptide
  MOD_RES (9)..(9): hLeu
CQTWQCYWLENGT

SEQ ID NO: 477 - protein, 13 aa, Artificial Sequence
  Description of Artificial Sequence: Synthetic peptide
  MOD_RES (9)..(9): hLeu
CQTWQCYWLENGR

SEQ ID NO: 478 - protein, 13 aa, Artificial Sequence
  Description of Artificial Sequence: Synthetic peptide
  MOD_RES (10)..(10): hLeu
PCQTWQCYWLENG

SEQ ID NO: 479 - protein, 13 aa, Artificial Sequence
  Description of Artificial Sequence: Synthetic peptide
  MOD_RES (10)..(10): hLeu
LCQTWQCYWLENG

SEQ ID NO: 480 - protein, 13 aa, Artificial Sequence
  Description of Artificial Sequence: Synthetic peptide
  MOD_RES (10)..(10): hLeu
FCQTWQCYWLENG

SEQ ID NO: 481 - protein, 13 aa, Artificial Sequence
  Description of Artificial Sequence: Synthetic peptide
  MOD_RES (10)..(10): hLeu
ECQTWQCYWLENG

SEQ ID NO: 482 - protein, 13 aa, Artificial Sequence
  Description of Artificial Sequence: Synthetic peptide
  MOD_RES (10)..(10): hLeu
NCQTWQCYWLENG

SEQ ID NO: 483 - protein, 13 aa, Artificial Sequence
  Description of Artificial Sequence: Synthetic peptide
  MOD_RES (10)..(10): hLeu
RCQTWQCYWLENG

SEQ ID NO: 484 - protein, 12 aa, Artificial Sequence
  Description of Artificial Sequence: Synthetic peptide
  MOD_RES (8)..(8): 2-Nal
  MOD_RES (9)..(9): hLeu
CQTWQCYXLENG

SEQ ID NO: 485 - protein, 12 aa, Artificial Sequence
  Description of Artificial Sequence: Synthetic peptide
  MOD_RES (8)..(8): 1-Nal
  MOD_RES (9)..(9): hLeu
CQTWQCYXLENG

SEQ ID NO: 486 - protein, 12 aa, Artificial Sequence
  Description of Artificial Sequence: Synthetic peptide
  MOD_RES (7)..(7): 2-Nal
  MOD_RES (9)..(9): hLeu
CQTWQCXWLENG

SEQ ID NO: 487 - protein, 12 aa, Artificial Sequence
  Description of Artificial Sequence: Synthetic peptide
  MOD_RES (7)..(7): 1-Nal
  MOD_RES (8)..(8): 2-Nal
  MOD_RES (9)..(9): hLeu
CQTWQCXXLENG

SEQ ID NO: 488 - protein, 12 aa, Artificial Sequence
  Description of Artificial Sequence: Synthetic peptide
  MOD_RES (7)..(7): 2-Nal
  MOD_RES (8)..(8): 1-Nal
  MOD_RES (9)..(9): hLeu
CQTWQCXXLENG

SEQ ID NO: 489 - protein, 12 aa, Artificial Sequence
  Description of Artificial Sequence: Synthetic peptide
  MOD_RES (7)..(7): Aic
  MOD_RES (9)..(9): hLeu
CQTWQCXWLENG

SEQ ID NO: 490 - protein, 12 aa, Artificial Sequence
  Description of Artificial Sequence: Synthetic peptide
  MOD_RES (9)..(9): hLeu
CQTWQCHWLENG

SEQ ID NO: 491 - protein, 12 aa, Artificial Sequence
  Description of Artificial Sequence: Synthetic peptide
  MOD_RES (9)..(9): hLeu
CQTWQCYHLENG

SEQ ID NO: 492 - protein, 12 aa, Artificial Sequence
  Description of Artificial Sequence: Synthetic peptide
  MOD_RES (7)..(7): Tyr(OMe)
  MOD_RES (9)..(9): hLeu
CQTWQCYWLENG

SEQ ID NO: 493 - protein, 12 aa, Artificial Sequence
  Description of Artificial Sequence: Synthetic peptide
  MOD_RES (8)..(8): Bip
  MOD_RES (9)..(9): hLeu
CQTWQCYXLENG

SEQ ID NO: 494 - protein, 12 aa, Artificial Sequence
  Description of Artificial Sequence: Synthetic peptide
  MOD_RES (8)..(8): Tyr(OMe)
  MOD_RES (9)..(9): hLeu
CQTWQCYYLENG

SEQ ID NO: 495 - protein, 12 aa, Artificial Sequence
  Description of Artificial Sequence: Synthetic peptide
  MOD_RES (9)..(9): hLeu
CQTWQCHHLENG

SEQ ID NO: 496 - protein, 12 aa, Artificial Sequence
  Description of Artificial Sequence: Synthetic peptide
  MOD_RES (8)..(8): alpha-MeTrp
  MOD_RES (9)..(9): hLeu
CQTWQCYWLEQG

SEQ ID NO: 497 - protein, 12 aa, Artificial Sequence
  Description of Artificial Sequence: Synthetic peptide
  MOD_RES (5)..(5): Lys(PEG8)
CQTWKCYWLENG

SEQ ID NO: 498 - protein, 12 aa, Artificial Sequence
  Description of Artificial Sequence: Synthetic peptide
  MOD_RES (9)..(9): Any amino acid
CQTWQCYWXLNG

SEQ ID NO: 499 - protein, 12 aa, Artificial Sequence
  Description of Artificial Sequence: Synthetic peptide
  MOD_RES (5)..(5): Lys(PEG8)
  MOD_RES (9)..(9): Lys(PEG8)
CQTWKCYWKENG

SEQ ID NO: 500 - protein, 12 aa, Artificial Sequence
  Description of Artificial Sequence: Synthetic peptide
  MOD_RES (5)..(5): Lys(Palm)
CQTWKCYWLENG

SEQ ID NO: 501 - protein, 12 aa, Artificial Sequence
  Description of Artificial Sequence: Synthetic peptide
  MOD_RES (9)..(9): Orn
  MOD_RES (10)..(10): Lys(Palm)
CQTWQCYWXKNG

SEQ ID NO: 502 - protein, 12 aa, Artificial Sequence
  Description of Artificial Sequence: Synthetic peptide
  MOD_RES (2)..(2): D-Asn
  MOD_RES (3)..(3): D-Glu
  MOD_RES (4)..(4): D-Leu
  MOD_RES (5)..(5): D-Trp
  MOD_RES (6)..(6): D-Tyr
  MOD_RES (7)..(7): D-Cys
  MOD_RES (8)..(8): D-Gln
  MOD_RES (9)..(9): D-Trp
  MOD_RES (10)..(10): D-Thr
  MOD_RES (11)..(11): D-Gln
  MOD_RES (12)..(12): D-Cys
GNELWYCQWTQC

SEQ ID NO: 503 - protein, 12 aa, Artificial Sequence
  Description of Artificial Sequence: Synthetic peptide
  MOD_RES (9)..(9): Orn
  MOD_RES (10)..(10): Lys(PEG8)
CQTWQCYWXKNG

SEQ ID NO: 504 - protein, 12 aa, Artificial Sequence
  Description of Artificial Sequence: Synthetic peptide
CRTWQCYWHEFG

SEQ ID NO: 505 - protein, 12 aa, Artificial Sequence
  Description of Artificial Sequence: Synthetic peptide
CRTWECYWHTFG

SEQ ID NO: 506 - protein, 12 aa, Artificial Sequence
  Description of Artificial Sequence: Synthetic peptide
CQTWQCYWHEFG

SEQ ID NO: 507 - protein, 14 aa, Artificial Sequence
  Description of Artificial Sequence: Synthetic peptide
CQTWQCYWRNFGDS

SEQ ID NO: 508 - protein, 14 aa, Artificial Sequence
  Description of Artificial Sequence: Synthetic peptide
CQTWQCYWRNFESG

SEQ ID NO: 509 - protein, 14 aa, Artificial Sequence
  Description of Artificial Sequence: Synthetic peptide
CQDWQCYWREFGPG

SEQ ID NO: 510 - protein, 14 aa, Artificial Sequence
  Description of Artificial Sequence: Synthetic peptide
CQDWQCYWRSFGPQ

SEQ ID NO: 511 - protein, 14 aa, Artificial Sequence
  Description of Artificial Sequence: Synthetic peptide
CQTWQCYWRTLGPS

SEQ ID NO: 512 - protein, 12 aa, Artificial Sequence
  Description of Artificial Sequence: Synthetic peptide
  MOD_RES (9)..(9): D-Pro
CQTWQCYWPENG

SEQ ID NO: 513 - protein, 12 aa, Artificial Sequence
  Description of Artificial Sequence: Synthetic peptide
CQTWQCYWELNG

SEQ ID NO: 514 - protein, 12 aa, Artificial Sequence
  Description of Artificial Sequence: Synthetic peptide
CQTWECYWELNG

SEQ ID NO: 515 - protein, 12 aa, Artificial Sequence
  Description of Artificial Sequence: Synthetic peptide
  MOD_RES (8)..(8): 1-Nal
  MOD_RES (9)..(9): alpha-MeLeu
CQTWQCYXLENG

SEQ ID NO: 516 - protein, 12 aa, Artificial Sequence
  Description of Artificial Sequence: Synthetic peptide
  MOD_RES (8)..(8): 1-Nal
  MOD_RES (9)..(9): D-Asn
CQTWQCYXNENG

SEQ ID NO: 517 - protein, 12 aa, Artificial Sequence
  Description of Artificial Sequence: Synthetic peptide
  MOD_RES (11)..(11): Lys(Palm)
CQTWQCYWLEKG

SEQ ID NO: 518 - protein, 12 aa, Artificial Sequence
  Description of Artificial Sequence: Synthetic peptide
  MOD_RES (12)..(12): Lys(Palm)
CQTWQCYWLENK

SEQ ID NO: 519 - protein, 12 aa, Artificial Sequence
  Description of Artificial Sequence: Synthetic peptide
CSTWECYWRTFG

SEQ ID NO: 520 - protein, 12 aa, Artificial Sequence
  Description of Artificial Sequence: Synthetic peptide
CDSWECYWRTYG

SEQ ID NO: 521 - protein, 12 aa, Artificial Sequence
  Description of Artificial Sequence: Synthetic peptide
CSTWECYWHTYG

SEQ ID NO: 522 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
XQTWQXFXKENG

SEQ ID NO: 523 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
XQTWQXFXKENG

SEQ ID NO: 524 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-Me-Leu
XQTWQXFXLQNN

SEQ ID NO: 525 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-Me-Leu
XQTWQXFXLQNN

SEQ ID NO: 526 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQXFXXKNQ

SEQ ID NO: 527 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQXFXXKNQ

SEQ ID NO: 528 - protein, 13 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeVal
  MOD_RES (10)..(10): Lys(Ac)
  MOD_RES (13)..(13): D-Lys
XQTWQXFXVKNNK

SEQ ID NO: 529 - protein, 13 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeVal
  MOD_RES (10)..(10): Lys(Ac)
  MOD_RES (13)..(13): D-Lys
XQTWQXFXVKNNK

SEQ ID NO: 530 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeVal
XQTWQXFXVKNN

SEQ ID NO: 531 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (10)..(10): Lys(Ac)
XQTWQXFXKKNN

SEQ ID NO: 532 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 533 - protein, 13 aa, Artificial Sequence
  Description of Artificial Sequence: Synthetic peptide
  MOD_RES (1)..(1): alpha-MeLys
  MOD_RES (2)..(2): Pen
  MOD_RES (7)..(7): Pen
  MOD_RES (8)..(8): Phe(4-CONH2)
  MOD_RES (9)..(9): 2-Nal
  MOD_RES (10)..(10): alpha-MeVal
  MOD_RES (11)..(11): Lys(Ac)
KXQTWQXFXVKNN

SEQ ID NO: 534 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 535 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Aib
XNTWQXFXXKNN

SEQ ID NO: 536 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): 4-amino-4-carboxy-tetrahydropyran
XNTWQXFXXKNN

SEQ ID NO: 537 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Achc
XNTWQXFXXKNN

SEQ ID NO: 538 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Acvc
XNTWQXFXXKNN

SEQ ID NO: 539 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLeu
XNTWQXFXLKNN

SEQ ID NO: 540 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
XNTWQXFXXKNN

SEQ ID NO: 541 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): 4-amino-4-carboxy-tetrahydropyran
XNTWQXFXXKNN

SEQ ID NO: 542 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Achc
XNTWQXFXXKNN

SEQ ID NO: 543 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Acvc
XNTWQXFXXKNN

SEQ ID NO: 544 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLeu
XNTWQXFXLKNN

SEQ ID NO: 545 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 546 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 547 - protein, 14 aa, Artificial Sequence
  Description of Artificial Sequence: Synthetic peptide
  MOD_RES (1)..(1): Pen
  MOD_RES (6)..(6): Pen
  MOD_RES (13)..(13): (2-aminoethoxy)acetic acid
  MOD_RES (14)..(14): D-Lys
XRTWQXYWRKFGXK

SEQ ID NO: 548 - protein, 14 aa, Artificial Sequence
  Description of Artificial Sequence: Synthetic peptide
  MOD_RES (2)..(2): Pen
  MOD_RES (6)..(6): Pen
  MOD_RES (13)..(13): (2-aminoethoxy)acetic acid
  MOD_RES (14)..(14): D-Lys
AXDWVXYWRKFGXK

SEQ ID NO: 549 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): hLeu
XQTWQXYWLENG

SEQ ID NO: 550 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): N-MeArg
XQTWQXYWRENG

SEQ ID NO: 551 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): hLeu
XQTWQXYWLENG

SEQ ID NO: 552 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): N-MeArg
XQTWQXYWRENG

SEQ ID NO: 553 - protein, 14 aa, Artificial Sequence
  Description of Artificial Sequence: Synthetic peptide
  MOD_RES (2)..(2): Pen
  MOD_RES (6)..(6): Pen
  MOD_RES (9)..(9): Orn
  MOD_RES (10)..(10): Dap
  MOD_RES (13)..(13): (2-aminoethoxy)acetic acid
  MOD_RES (14)..(14): D-Lys
AXDWVXYWXXFGXK

SEQ ID NO: 554 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): alpha-MeLeu
XQTWQXYWLENG

SEQ ID NO: 555 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): D-Asn
XQTWQXYWNENG

SEQ ID NO: 556 - protein, 12 aa, Artificial Sequence
  Description of Artificial Sequence: Synthetic peptide
  MOD_RES (1)..(1): Pen
  MOD_RES (6)..(6): Pen
  MOD_RES (8)..(8): 2-Nal
  MOD_RES (9)..(9): alpha-MeLys
XQTWQXYXKENG

SEQ ID NO: 557 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
XQTWQXFXKENG

SEQ ID NO: 558 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): 2-Nal
  MOD_RES (8)..(8): 2-Nal
  MOD_RES (9)..(9): alpha-MeLys
XQTWQXXXKENG

SEQ ID NO: 559 - protein, 12 aa, Artificial Sequence
  Description of Artificial Sequence: Synthetic peptide
  MOD_RES (1)..(1): Pen
  MOD_RES (6)..(6): Pen
  MOD_RES (8)..(8): 2-Nal
  MOD_RES (9)..(9): alpha-MeOrn
XQTWQXYXXENG

SEQ ID NO: 560 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): alpha-MeOrn
XQTWQXYWXENG

SEQ ID NO: 561 - protein, 12 aa, Artificial Sequence
  Description of Artificial Sequence: Synthetic peptide
  MOD_RES (1)..(1): Pen
  MOD_RES (6)..(6): Pen
  MOD_RES (8)..(8): 1-Nal
  MOD_RES (9)..(9): alpha-MeOrn
XQTWQXYXXENG

SEQ ID NO: 562 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeOrn
  MOD_RES (10)..(10): Lys(Ac)
XQTWQXFXXKNG

SEQ ID NO: 563 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): alpha-MeLys
  MOD_RES (10)..(10): Lys(Ac)
XQTWQXYWKKNG

SEQ ID NO: 564 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe-(4-OMe)
  MOD_RES (9)..(9): alpha-MeLys
  MOD_RES (10)..(10): Lys(Ac)
XQTWQXFWKKNG

SEQ ID NO: 565 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 566 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 1-Nal
  MOD_RES (9)..(9): alpha-MeLys
  MOD_RES (10)..(10): Lys(Ac)
XQTWQXFXKKNG

SEQ ID NO: 567 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Bip
  MOD_RES (8)..(8): 2-Nal
  MOD_RES (9)..(9): alpha-MeLys
  MOD_RES (10)..(10): Lys(Ac)
XQTWQXXXKKNG

SEQ ID NO: 568 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(3,4-Cl2)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 569 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(3,5-F2)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 570 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-NH2)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 571 - protein, 11 aa, Artificial Sequence
  Description of Artificial Sequence: Synthetic peptide
  MOD_RES (1)..(1): Pen
  MOD_RES (6)..(6): Pen
  MOD_RES (7)..(7): 2-Nal
  MOD_RES (8)..(8): alpha-MeLys
  MOD_RES (9)..(9): Lys(Ac)
XQTWQXXKKNG

SEQ ID NO: 572 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(3,4-Cl2)
  MOD_RES (8)..(8): 2-Nal
  MOD_RES (9)..(9): alpha-MeOrn
XQTWQXFXXENG

SEQ ID NO: 573 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CN)
  MOD_RES (8)..(8): 2-Nal
  MOD_RES (9)..(9): alpha-MeOrn
XQTWQXFXXENG

SEQ ID NO: 574 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(3,5-F2)
  MOD_RES (8)..(8): 2-Nal
  MOD_RES (9)..(9): alpha-MeOrn
XQTWQXFXXENG

SEQ ID NO: 575 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CH2CO2H)
  MOD_RES (8)..(8): 2-Nal
  MOD_RES (9)..(9): alpha-MeOrn
XQTWQXFXXENG

SEQ ID NO: 576 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CH2COEt2)
  MOD_RES (8)..(8): 2-Nal
  MOD_RES (9)..(9): alpha-MeOrn
XQTWQXFXXENG

SEQ ID NO: 577 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(penta-F)
  MOD_RES (8)..(8): 2-Nal
  MOD_RES (9)..(9): alpha-MeOrn
XQTWQXFXXENG

SEQ ID NO: 578 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CF3)
  MOD_RES (8)..(8): 2-Nal
  MOD_RES (9)..(9): alpha-MeLys
XQTWQXFXKENG

SEQ ID NO: 579 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XQTWQXFXKENG

SEQ ID NO: 580 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XQTWQXFXKENG

SEQ ID NO: 581 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(ivDde)
XQTWQXFXKKNG

SEQ ID NO: 582 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 583 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 584 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 585 - protein, 13 aa, Artificial Sequence
  Description of Artificial Sequence: Synthetic peptide
  MOD_RES (1)..(1): PyroGlu
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): alpha-MeLys
  MOD_RES (11)..(11): Lys(Ac)
EXQTWQXFXKKNG

SEQ ID NO: 586 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 587 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 588 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 589 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 590 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 591 - protein, 12 aa, Artificial Sequence
  Description of Artificial Sequence: Synthetic peptide
  MOD_RES (1)..(1): Pen
  MOD_RES (6)..(6): Pen
XADWVXYWHTFG

SEQ ID NO: 592 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XGTWQXFXKENG

SEQ ID NO: 593 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XTTWQXFXKENG

SEQ ID NO: 594 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XSTWQXFXKENG

SEQ ID NO: 595 - protein, 12 aa, Artificial Sequence
  Description of Artificial Sequence: Synthetic peptide
  MOD_RES (1)..(1): Pen
  MOD_RES (2)..(2): Dap
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XXTWQXFXKENG

SEQ ID NO: 596 - protein, 12 aa, Artificial Sequence
  Description of Artificial Sequence: Synthetic peptide
  MOD_RES (1)..(1): Pen
  MOD_RES (2)..(2): alpha-MeOrn
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XXTWQXFXKENG

SEQ ID NO: 597 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XNTWQXFXKENG

SEQ ID NO: 598 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 599 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 600 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XQTWQXFXKENG

SEQ ID NO: 601 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
XQTWQXFXKENA

SEQ ID NO: 602 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Lys(Ac)
XQTWQXFXLKNN

SEQ ID NO: 603 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLeu
XQTWQXFXLQNN

SEQ ID NO: 604 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
XQTWQXFXXENN

SEQ ID NO: 605 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQXFXXKNN

SEQ ID NO: 606 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQXFXXKNQ

SEQ ID NO: 607 - protein, 12 aa, Artificial Sequence
  Description of Artificial Sequence: Synthetic peptide
  MOD_RES (1)..(1): Pen
  MOD_RES (2)..(2): Dap(Ac)
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLys(Ac)
XXTWQXFXKENG

SEQ ID NO: 608 - protein, 12 aa, Artificial Sequence
  Description of Artificial Sequence: Synthetic peptide
  MOD_RES (1)..(1): Pen
  MOD_RES (2)..(2): alpha-MeOrn(Ac)
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLys(Ac)
XXTWQXFXKENG

SEQ ID NO: 609 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLys(Ac)
  MOD_RES (10)..(10): Lys(Ac)
XQTWQXFXKKNG

SEQ ID NO: 610 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLys(Ac)
  MOD_RES (10)..(10): Lys(Ac)
XQTWQXFXKKNN

SEQ ID NO: 611 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLys(Ac)
XQTWQXFXKENG

SEQ ID NO: 612 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLys(Ac)
XQTWQXFXKENA

SEQ ID NO: 613 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLeu
  MOD_RES (10)..(10): Lys(Ac)
XQTWQXFXLKNN

SEQ ID NO: 614 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeLeu
XQTWQXFXLQNN

SEQ ID NO: 615 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): Aib
XQTWQXFXXENN

SEQ ID NO: 616 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): Aib
  MOD_RES (10)..(10): Lys(Ac)
XQTWQXFXXKNN

SEQ ID NO: 617 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): Aib
  MOD_RES (10)..(10): Lys(Ac)
XQTWQXFXXKNQ

SEQ ID NO: 618 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
XQTWQXFXXENN

SEQ ID NO: 619 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): hLeu
XQTWQXFXLENA

SEQ ID NO: 620 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XTTWQXFXXKNN

SEQ ID NO: 621 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XQTWQXFXXKNA

SEQ ID NO: 622 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XTTWQXFXXKNQ

SEQ ID NO: 623 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XQTWQXFXXKNQ

SEQ ID NO: 624 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQXFXXKNA

SEQ ID NO: 625 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XQTWQXFXXKNN

SEQ ID NO: 626 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): hLeu
  MOD_RES (10)..(10): Lys(Ac)
  MOD_RES (12)..(12): Beta-Ala
XQTWQXFXLKNA

SEQ ID NO: 627 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): hLeu
  MOD_RES (10)..(10): Lys(Ac)
  MOD_RES (12)..(12): Beta-Ala
XQTWQXFXLKNA

SEQ ID NO: 628 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
  MOD_RES (12)..(12): Beta-Ala
XQTWQXFXXKNA

SEQ ID NO: 629 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
  MOD_RES (12)..(12): Beta-Ala
XQTWQXFXXKNA

SEQ ID NO: 630 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
XNTWQXFXXENN

SEQ ID NO: 631 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): hLeu
XNTWQXFXLENA

SEQ ID NO: 632 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XNTWQXFXXKNN

SEQ ID NO: 633 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
  MOD_RES (12)..(12): Beta-Ala
XNTWQXFXXKNA

SEQ ID NO: 634 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XNTWQXFXXKNQ

SEQ ID NO: 635 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XNTWQXFXXKNA

SEQ ID NO: 636 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XNTWQXFXXKNA

SEQ ID NO: 637 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XNTWQXFXXKNN

SEQ ID NO: 638 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XNTWQXFXXKNQ

SEQ ID NO: 639 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
  MOD_RES (12)..(12): Beta-Ala
XNTWQXFXXKNA

SEQ ID NO: 640 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): hLeu
  MOD_RES (10)..(10): Lys(Ac)
  MOD_RES (12)..(12): Beta-Ala
XNTWQXFXLKNA

SEQ ID NO: 641 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): hLeu
  MOD_RES (10)..(10): Lys(Ac)
  MOD_RES (12)..(12): Beta-Ala
XNTWQXFXLKNA

SEQ ID NO: 642 - protein, 13 aa, Artificial Sequence
  Description of Artificial Sequence: Synthetic peptide
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
EXQTWQXFXXKNN

SEQ ID NO: 643 - protein, 13 aa, Artificial Sequence
  Description of Artificial Sequence: Synthetic peptide
  MOD_RES (1)..(1): D-Asp
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
DXQTWQXFXXKNN

SEQ ID NO: 644 - protein, 13 aa, Artificial Sequence
  Description of Artificial Sequence: Synthetic peptide
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
RXQTWQXFXXKNN

SEQ ID NO: 645 - protein, 13 aa, Artificial Sequence
  Description of Artificial Sequence: Synthetic peptide
  MOD_RES (1)..(1): D-Arg
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
RXQTWQXFXXKNN

SEQ ID NO: 646 - protein, 13 aa, Artificial Sequence
  Description of Artificial Sequence: Synthetic peptide
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
FXQTWQXFXXKNN

SEQ ID NO: 647 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
FXQTWQXFXXKNN

SEQ ID NO: 648 - protein, 13 aa, Artificial Sequence
  Description of Artificial Sequence: Synthetic peptide
  MOD_RES (1)..(1): 2-Nal
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
XXQTWQXFXXKNN

SEQ ID NO: 649 - protein, 13 aa, Artificial Sequence
  Description of Artificial Sequence: Synthetic peptide
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
TXQTWQXFXXKNN

SEQ ID NO: 650 - protein, 13 aa, Artificial Sequence
  Description of Artificial Sequence: Synthetic peptide
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
LXQTWQXFXXKNN

SEQ ID NO: 651 - protein, 13 aa, Artificial Sequence
  Description of Artificial Sequence: Synthetic peptide
  MOD_RES (1)..(1): D-Gln
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
QXQTWQXFXXKNN

SEQ ID NO: 652 - protein, 13 aa, Artificial Sequence
  Description of Artificial Sequence: Synthetic peptide
  MOD_RES (1)..(1): D-Asn
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
NXQTWQXFXXKNN

SEQ ID NO: 653 - protein, 13 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeVal
  MOD_RES (10)..(10): Lys(Ac)
  MOD_RES (13)..(13): D-Lys
XQTWQXFXVKNNK

SEQ ID NO: 654 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeVal
XQTWQXFXVKNN

SEQ ID NO: 655 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (10)..(10): Lys(Ac)
XQTWQXFXKKNN

SEQ ID NO: 656 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
  MOD_RES (10)..(10): Lys(Ac)
XQTWQCFXKKNG

SEQ ID NO: 657 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
XQTWQCFXKENG

SEQ ID NO: 658 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): 4-amino-4-carboxy-tetrahydropyran
XQTWQCFXXENN

SEQ ID NO: 659 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKENQ

SEQ ID NO: 660 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeVal
  MOD_RES (10)..(10): Lys(Ac)
XQTWQCFXVKNG

SEQ ID NO: 661 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): hLeu
  MOD_RES (10)..(10): Lys(Ac)
  MOD_RES (12)..(12): Beta-Ala
XQTWQCFXLKNA

SEQ ID NO: 662 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]]
  MOD_RES (8)..(8): 2-Nal
  MOD_RES (9)..(9): alpha-MeLys(Ac)
XQTWQCFXKENQ

SEQ ID NO: 663 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
XQTWQCFXKENN

SEQ ID NO: 664 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLENN

SEQ ID NO: 665 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Cit
XQTWQCFXLXNN

SEQ ID NO: 666 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 667 - protein, 13 aa, Artificial Sequence
  Description of Artificial Sequence: Synthetic peptide
  MOD_RES (1)..(1): D-Lys
  MOD_RES (2)..(2): Pen
  MOD_RES (7)..(7): Pen
  MOD_RES (8)..(8): Phe(4-CONH2)
  MOD_RES (9)..(9): 2-Nal
  MOD_RES (10)..(10): alpha-MeVal
  MOD_RES (11)..(11): Lys(Ac)
KXQTWQXFXVKNN

SEQ ID NO: 668 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 669 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeVal
  MOD_RES (10)..(10): Lys(Ac)
XQTWQXFXVKNN

SEQ ID NO: 670 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): Phe(3,4-OMe2)
  MOD_RES (9)..(9): alpha-MeVal
  MOD_RES (10)..(10): Lys(Ac)
XQTWQXFFVKNN

SEQ ID NO: 671 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
FXNTWQXFXXKNN

SEQ ID NO: 672 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): 4-amino-4-carboxy-tetrahydropyran
  MOD_RES (11)..(11): Lys(Ac)
FXNTWQXFXXKNN

SEQ ID NO: 673 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Achc
  MOD_RES (11)..(11): Lys(Ac)
FXNTWQXFXXKNN

SEQ ID NO: 674 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): 4-amino-4-carboxy-tetrahydropyran
  MOD_RES (11)..(11): Cit
FXNTWQXFXXXNN

SEQ ID NO: 675 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Achc
  MOD_RES (11)..(11): Cit
FXNTWQXFXXXNN

SEQ ID NO: 676 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
  MOD_RES (13)..(13): Beta-Ala
FXNTWQXFXXKNA

SEQ ID NO: 677 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): 4-amino-4-carboxy-tetrahydropyran
  MOD_RES (11)..(11): Lys(Ac)
FXNTWQXFXXKNN

SEQ ID NO: 678 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): Achc
  MOD_RES (11)..(11): Lys(Ac)
FXNTWQXFXXKNN

SEQ ID NO: 679 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): 4-amino-4-carboxy-tetrahydropyran
  MOD_RES (11)..(11): Cit
FXNTWQXFXXXNN

SEQ ID NO: 680 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): Achc
  MOD_RES (11)..(11): Cit
FXNTWQXFXXXNN

SEQ ID NO: 681 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): Achc
FXNTWQXFXXENN

SEQ ID NO: 682 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Aib
  MOD_RES (10)..(10): Lys(Ac)
XNTWQXFXXKNN

SEQ ID NO: 683 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): 4-amino-4-carboxy-tetrahydropyran
  MOD_RES (10)..(10): Lys(Ac)
XNTWQXFXXKNN

SEQ ID NO: 684 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Achc
  MOD_RES (10)..(10): Lys(Ac)
XNTWQXFXXKNN

SEQ ID NO: 685 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Acpc
  MOD_RES (10)..(10): Lys(Ac)
XNTWQXFXXKNN

SEQ ID NO: 686 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): alpha-MeLeu
  MOD_RES (10)..(10): Lys(Ac)
XNTWQXFXLKNN

SEQ ID NO: 687 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Aib
  MOD_RES (10)..(10): Lys(Ac)
XNTWQXFXXKNN

SEQ ID NO: 688 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): 4-amino-4-carboxy-tetrahydropyran
  MOD_RES (10)..(10): Lys(Ac)
XNTWQXFXXKNN

SEQ ID NO: 689 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Achc
  MOD_RES (10)..(10): Lys(Ac)
XNTWQXFXXKNN

SEQ ID NO: 690 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 691 - protein, 14 aa, Artificial Sequence
  Description of Artificial Sequence: Synthetic peptide
  MOD_RES (5)..(5): hCys
  MOD_RES (13)..(13): (2-aminoethoxy)acetic acid
  MOD_RES (14)..(14): D-Lys
QDWQCCYWRENGXK

SEQ ID NO: 692 - protein, 14 aa, Artificial Sequence
  Description of Artificial Sequence: Synthetic peptide
  MOD_RES (1)..(1): Abu
  MOD_RES (13)..(13): (2-aminoethoxy)acetic acid
  MOD_RES (14)..(14): D-Lys
XRTWQCYWRKFGXK

SEQ ID NO: 693 - protein, 14 aa, Artificial Sequence
  Description of Artificial Sequence: Synthetic peptide
  MOD_RES (6)..(6): Abu
  MOD_RES (13)..(13): (2-aminoethoxy)acetic acid
  MOD_RES (14)..(14): D-Lys
CRTWQXYWRKFGXK

SEQ ID NO: 694 - protein, 14 aa, Artificial Sequence
  Description of Artificial Sequence: Synthetic peptide
  MOD_RES (1)..(1): Abu
  MOD_RES (13)..(13): (2-aminoethoxy)acetic acid
  MOD_RES (14)..(14): D-Lys
XQTWQCYWRENGXK

SEQ ID NO: 695 - protein, 14 aa, Artificial Sequence
  Description of Artificial Sequence: Synthetic peptide
  MOD_RES (1)..(1): Abu
  MOD_RES (6)..(6): Pen
  MOD_RES (13)..(13): (2-aminoethoxy)acetic acid
  MOD_RES (14)..(14): D-Lys
XRTWQXYWRKFGXK

SEQ ID NO: 696 - protein, 14 aa, Artificial Sequence
  Description of Artificial Sequence: Synthetic peptide
  MOD_RES (1)..(1): Pen
  MOD_RES (6)..(6): Abu
  MOD_RES (13)..(13): (2-aminoethoxy)acetic acid
  MOD_RES (14)..(14): D-Lys
XRTWQXYWRKFGXK

SEQ ID NO: 697 - protein, 14 aa, Artificial Sequence
  Description of Artificial Sequence: Synthetic peptide
  MOD_RES (1)..(1): D-Cys
  MOD_RES (6)..(6): Abu
  MOD_RES (13)..(13): (2-aminoethoxy)acetic acid
  MOD_RES (14)..(14): D-Lys
CRTWQXYWRKFGXK

SEQ ID NO: 698 - protein, 14 aa, Artificial Sequence
  Description of Artificial Sequence: Synthetic peptide
  MOD_RES (1)..(1): Abu
  MOD_RES (9)..(9): Orn
  MOD_RES (10)..(10): Dap
  MOD_RES (13)..(13): (2-aminoethoxy)acetic acid
  MOD_RES (14)..(14): D-Lys
XQTWQCYWXXNGXK

SEQ ID NO: 699 - protein, 12 aa, Artificial Sequence
  Description of Artificial Sequence: Synthetic peptide
  MOD_RES (1)..(1): Abu
  MOD_RES (9)..(9): hLeu
XQTWQCYWLENG

SEQ ID NO: 700 - protein, 12 aa, Artificial Sequence
  Description of Artificial Sequence: Synthetic peptide
  MOD_RES (1)..(1): Abu
  MOD_RES (6)..(6): D-Cys
  MOD_RES (9)..(9): hLeu
XQTWQCYWLENG

SEQ ID NO: 701 - protein, 12 aa, Artificial Sequence
  Description of Artificial Sequence: Synthetic peptide
  MOD_RES (1)..(1): Abu
  MOD_RES (6)..(6): Pen
  MOD_RES (9)..(9): hLeu
XQTWQXYWLENG

SEQ ID NO: 702 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 703 - protein, 12 aa, Artificial Sequence
  Description of Artificial Sequence: Synthetic peptide
  MOD_RES (1)..(1): Abu
  MOD_RES (9)..(9): alpha-MeLeu
XQTWQCYWLENG

SEQ ID NO: 704 - protein, 12 aa, Artificial Sequence
  Description of Artificial Sequence: Synthetic peptide
  MOD_RES (1)..(1): Abu
  MOD_RES (8)..(8): 2-Nal
  MOD_RES (9)..(9): alpha-MeLys
XQTWQCYXKENG

SEQ ID NO: 705 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 706 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeOrn
XQTWQCFXXENG

SEQ ID NO: 707 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (9)..(9): alpha-MeOrn
XQTWQCFWXENG

SEQ ID NO: 708 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 709 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (9)..(9): alpha-MeLys
  MOD_RES (10)..(10): Lys(Ac)
XQTWQCFWKKNG

SEQ ID NO: 710 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (9)..(9): alpha-MeLys
XQTWQCFWKENG

SEQ ID NO: 711 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 1-Nal
  MOD_RES (9)..(9): alpha-MeLys
  MOD_RES (10)..(10): Lys(Ac)
XQTWQCFXKKNG

SEQ ID NO: 712 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 713 - protein, 12 aa, Artificial Sequence
  Description of Artificial Sequence: Synthetic peptide
  MOD_RES (1)..(1): Abu
  MOD_RES (9)..(9): alpha-MeOrn
  MOD_RES (10)..(10): Lys(Ac)
XQTWQCYWXKNG

SEQ ID NO: 714 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): D-Asn
  MOD_RES (10)..(10): Lys(Ac)
XQTWQCFXNKNG

SEQ ID NO: 715 - protein, 12 aa, Artificial Sequence
  Description of Artificial Sequence: Synthetic peptide
  MOD_RES (1)..(1): Abu
  MOD_RES (7)..(7): Phe(4-Phenoxy)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 716 - protein, 12 aa, Artificial Sequence
  Description of Artificial Sequence: Synthetic peptide
  MOD_RES (1)..(1): Abu
  MOD_RES (7)..(7): hPhe(3,4-dimethoxy)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 717 - protein, 12 aa, Artificial Sequence
  Description of Artificial Sequence: Synthetic peptide
  MOD_RES (1)..(1): Abu
  MOD_RES (7)..(7): DMT
  MOD_RES (8)..(8): 2-Nal
  MOD_RES (9)..(9): alpha-MeLys
  MOD_RES (10)..(10): Lys(Ac)
XQTWQCXXKKNG

SEQ ID NO: 718 - protein, 12 aa, Artificial Sequence
  Description of Artificial Sequence: Synthetic peptide
  MOD_RES (1)..(1): Abu
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 719 - protein, 12 aa, Artificial Sequence
  Description of Artificial Sequence: Synthetic peptide
  MOD_RES (1)..(1): Abu
  MOD_RES (7)..(7): Phe(3,4-Cl2)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 720 - protein, 12 aa, Artificial Sequence
  Description of Artificial Sequence: Synthetic peptide
  MOD_RES (1)..(1): Abu
  MOD_RES (6)..(6): Pen
  MOD_RES (7)..(7): Phe(4-OMe)
  MOD_RES (8)..(8): 2-Nal
  MOD_RES (9)..(9): alpha-MeLys
XQTWQXFXKENG

SEQ ID NO: 721 - protein, 12 aa, Artificial Sequence
  Description of Artificial Sequence: Synthetic peptide
  MOD_RES (1)..(1): Abu
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 722 - protein, 12 aa, Artificial Sequence
  Description of Artificial Sequence: Synthetic peptide
  MOD_RES (1)..(1): Pen
  MOD_RES (6)..(6): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 723 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Trp(2,5,7-tri-tert-Butyl)
  MOD_RES (9)..(9): alpha-MeLys
XQTWQCFWKENG

SEQ ID NO: 724 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Phe(4-Oallyl)
  MOD_RES (9)..(9): alpha-MeLys
XQTWQCFFKENG

SEQ ID NO: 725 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Tyr(3-tBu)
  MOD_RES (9)..(9): alpha-MeLys
XQTWQCFYKENG

SEQ ID NO: 726 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Phe(4-tBu)
  MOD_RES (9)..(9): alpha-MeLys
XQTWQCFFKENG

SEQ ID NO: 727 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Phe(4-guanidino)
  MOD_RES (9)..(9): alpha-MeLys
XQTWQCFFKENG

SEQ ID NO: 728 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Phe(Bzl)
  MOD_RES (9)..(9): alpha-MeLys
XQTWQCFFKENG

SEQ ID NO: 729 - protein, 12 aa, Artificial Sequence
  Description of Artificial Sequence: Synthetic peptide
  MOD_RES (1)..(1): Abu
  MOD_RES (7)..(7): Tyr(3-tBu)
  MOD_RES (9)..(9): alpha-MeLys
XQTWQCYWKENG

SEQ ID NO: 730 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Acpc
  MOD_RES (10)..(10): Lys(Ac)
XNTWQXFXXKNN

SEQ ID NO: 731 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLeu
  MOD_RES (10)..(10): Lys(Ac)
XNTWQXFXLKNN

SEQ ID NO: 732 - protein, 13 aa, Artificial Sequence
  Description of Artificial Sequence: Synthetic peptide
  MOD_RES (1)..(1): N-MeAla
  MOD_RES (12)..(12): (2-aminoethoxy)acetic acid
  MOD_RES (13)..(13): D-Lys
ADWVCYWHTFGXK

SEQ ID NO: 733 - protein, 13 aa, Artificial Sequence
  Description of Artificial Sequence: Synthetic peptide
  MOD_RES (1)..(1): N-MeAla
  MOD_RES (5)..(5): Pen
  MOD_RES (12)..(12): (2-aminoethoxy)acetic acid
  MOD_RES (13)..(13): D-Lys
ADWVXYWHTFGXK

SEQ ID NO: 734 - protein, 13 aa, Artificial Sequence
  Description of Artificial Sequence: Synthetic peptide
  MOD_RES (1)..(1): N-MeAla
  MOD_RES (5)..(5): D-Pen
  MOD_RES (12)..(12): (2-aminoethoxy)acetic acid
  MOD_RES (13)..(13): D-Lys
ADWVXYWHTFGXK

SEQ ID NO: 735 - protein, 13 aa, Artificial Sequence
  Description of Artificial Sequence: Synthetic peptide
  MOD_RES (1)..(1): N-MeAla
  MOD_RES (5)..(5): hCys
  MOD_RES (12)..(12): (2-aminoethoxy)acetic acid
  MOD_RES (13)..(13): D-Lys
ADWVCYWHTFGXK

SEQ ID NO: 736 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
ADWVCYWHTFGXK

SEQ ID NO: 737 - protein, 13 aa, Artificial Sequence
  Description of Artificial Sequence: Synthetic peptide
  MOD_RES (5)..(5): Pen
  MOD_RES (12)..(12): (2-aminoethoxy)acetic acid
  MOD_RES (13)..(13): D-Lys
ADWVXYWHTFGXK

SEQ ID NO: 738 - protein, 13 aa, Artificial Sequence
  Description of Artificial Sequence: Synthetic peptide
  MOD_RES (5)..(5): D-Pen
  MOD_RES (12)..(12): (2-aminoethoxy)acetic acid
  MOD_RES (13)..(13): D-Lys
ADWVXYWHTFGXK

SEQ ID NO: 739 - protein, 13 aa, Artificial Sequence
  Description of Artificial Sequence: Synthetic peptide
  MOD_RES (5)..(5): hCys
  MOD_RES (12)..(12): (2-aminoethoxy)acetic acid
  MOD_RES (13)..(13): D-Lys
ADWVCYWHTFGXK

SEQ ID NO: 740 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 741 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 742 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 743 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 744 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 745 - protein, 13 aa, Artificial Sequence
  Description of Artificial Sequence: Synthetic peptide
  MOD_RES (12)..(12): (2-aminoethoxy)acetic acid
  MOD_RES (13)..(13): D-Lys
QDWQCYWRENGXK

SEQ ID NO: 746 - protein, 13 aa, Artificial Sequence
  Description of Artificial Sequence: Synthetic peptide
  MOD_RES (5)..(5): hCys
  MOD_RES (12)..(12): (2-aminoethoxy)acetic acid
  MOD_RES (13)..(13): D-Lys
QDWQCYWRENGXK

SEQ ID NO: 747 - protein, 13 aa, Artificial Sequence
  Description of Artificial Sequence: Synthetic peptide
  MOD_RES (5)..(5): hCys
  MOD_RES (12)..(12): (2-aminoethoxy)acetic acid
  MOD_RES (13)..(13): D-Lys
QDWQCYWRENGXK

SEQ ID NO: 748 - protein, 13 aa, Artificial Sequence
  Description of Artificial Sequence: Synthetic peptide
  MOD_RES (5)..(5): hCys
  MOD_RES (12)..(12): (2-aminoethoxy)acetic acid
  MOD_RES (13)..(13): D-Lys
QDWQCYWRENGXK

SEQ ID NO: 749 - protein, 13 aa, Artificial Sequence
  Description of Artificial Sequence: Synthetic peptide
  MOD_RES (5)..(5): hCys
  MOD_RES (12)..(12): (2-aminoethoxy)acetic acid
  MOD_RES (13)..(13): D-Lys
QDWQCYWRENGXK

SEQ ID NO: 750-751 - skipped (2 entries)

SEQ ID NO: 752 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (12)..(12): Beta-Ala
XQTWQCFXLQNA

SEQ ID NO: 753 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Acbc
XQTWQCFXXENN

SEQ ID NO: 754 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Achc
XQTWQCFXXENN

SEQ ID NO: 755 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]]
  MOD_RES (8)..(8): 2-Nal
  MOD_RES (9)..(9): Acvc
XQTWQCFXXENN

SEQ ID NO: 756 - protein, 13 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeVal
  MOD_RES (10)..(10): Lys(Ac)
  MOD_RES (13)..(13): D-Lys
XQTWQXFXVKNNK

SEQ ID NO: 757 - protein, 13 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]
  MOD_RES (8)..(8): 2-Nal
  MOD_RES (9)..(9): alpha-MeVal
  MOD_RES (10)..(10): Lys(Ac)
  MOD_RES (13)..(13): D-Lys
XQTWQXFXVKNNK

SEQ ID NO: 758 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]]
  MOD_RES (8)..(8): 2-Nal
  MOD_RES (9)..(9): alpha-MeVal
XQTWQXFXVKNN

SEQ ID NO: 759 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-acetylaminoethoxy)]]
  MOD_RES (8)..(8): 2-Nal
  MOD_RES (10)..(10): Lys(Ac)
XQTWQXFXKKNN

SEQ ID NO: 760 - protein, 629 aa, Homo sapiens
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWKSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 761 - protein, 659 aa, Mus musculus
MKREREMRGFYYIWDMSHLTLQLHVVIALYVLFRWCHGGITSINCSGDMWVEPGEIFQMGMNVSIYCQEALKHCRPRNLYFYKNGFKEEFDITRINRTTARIWYKGFSEPHAYMHCTAECPGHFQETLICGKDISSGYPPDAPSNLTCVIYEYSGNMTCTWNTGKPTYIDTKYIVHVKSLETEEEQQYLASSYVKISTDSLQGGKKYLVWVQAVNSLGMENSQQLHVHLDDIVIPSASIISRAETTNDTVPKTIIYWKSKTMIEKVFCEMRYKTTTNQTWSVKEFDANFTYVQQSEFYLEPDSKYVFQVRCQETGKRNWQPWSSPFVHQTSQETGKRNWQPWSSPFVHQTSQTVSQVTAKSSHEPQKMEMLSATIFRGHPASGNHQDIGLLSGMVFLAIMLPIFSLIGIFNRSLRIGIKRKVLLMIPKWLYEDIPNMENSNVAKLLQEKSVFENDNASEQALYVDPVLTEISEISPLEHKPTDYKEERLTGLLETRDCPLGMLSTSSSVVYIPDLNTGYKPQVSNVPPGGNLFINRDERDPTSLETTDDHFARLKTYPNFQFSASSMALLNKTLILDELCLVLNQGEFNSLDIKNSRQEETSIVLQSDSPSETIPAQTLLSDEFVSCLAIGNEDLPSINSYFPQNVLESHFSRISLFQK

SEQ ID NO: 762 - protein, 639 aa, Rattus norvegicus
MRREREMRGFYYIWDMSHVALQLHVVIALYALFRWGHGGIATINCSGNMWVEPGEIFQMGMNVSVYCQEALKNCRPRNLHFYKNGFKERFHITRINRTTARVWTKGFSEPHASMYCTAECPGRFQETLICGKDISSGYPPDAPSNMTCVIYEYSGNMTCTWNTGKPTYIDTKYTVHVKSLETEEQQQYLASNYVNISTDSLQGGKKYLVWVQAVNALGMENSQQLQVHLDDIVIPSPSIISRAETTNANVPKTIIYWKSKIMTGKVFCEMRYKATTNQTWNVKEFDTNFTYVQQSEFYLEPNSKYVFQVRCQGTGKRYWQPWSSPFVHQTPQTASQVTSKPPHEPQKIEMLTATIFKGHSTSDNSQDIGLLSGMVFLAIMLPIFSLIGIFNRSLRIGIKRKVLLMIPKWLYEDIPNMENSNIAKLLQEKSVFENENASEQALYVDPILTEISEISPLEHKPTDYKKDRLTGFLETRDCPLTTLSTSSSVVYIPDLNTGYKPQVSNVPPEENHFINRDERDPMSLEATGDHFARLKTYPNFTFSASSMTSLSKTLILDELSLVLNQGEFNSLDIQNSRQEETSMILQNDSPSETIPVQTLLPDEFVSCLAIGSEDLPSINSYFPQNVLESHFSGIPLLQK

SEQ ID NO: 763 - protein, 629 aa, Pan sp.
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYMDTKYVVHVKSLETEEEQQYLTSSYINISTDSLQGGKKYLVWVQAANALGMEESKQLQIYLDDIVIPSASVISRAETINATVPKTIIYWDSQTTIEKVSCEMRYKATTNQTWNVKEFDTNFTYVQQSEFYLEPNIKYVFQVRCQETGKRYWQPWSSPFFHKTPETVPQVTSKAFQHDTWNSGLTVASISTGHLTSDNRGDIGLLLGMIVFAVMLSILSLIGIFNRSLRTGIKRRILLLIPKWLYEDIPNMKNSNVVKMLQENSELMNNNSSEQVLYVDPMITEIKEIFIPEHKPTDYKKLNTGPLETRDTLQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTTLLENDSPSETIPEQTLLPDEFVSCLGIVNEELPSINTYFPQNILESHFNRISLLEK

SEQ ID NO: 764 - protein, 631 aa, Canis familiaris
MNQITIQWDVVIALYIFFNWCHGGITNINCSGHIWVEPATIFKMGMNISIYCQAAIKNCQPRKLYFYKNGIKERFQITRINKTTARLWYSNFLEPHASMYCTAECPGYPQETLICGKDISSGYPPDVPDKVTCVIYEYSGNMTCTWNSGKPTYIDTKYVVYVKSLEKEEEQQYLSSSYINISTDSLQGGKKYLVWVQAANALGMEKSKQLQINLDDIVIPSAAIISRAEDINTTIPKTIIHWNSQTTIENVSCEMRHKTTTNQTWKVKEFDTNFPYEQQSEFYLEPNTKYIFQVRCQETGKRYWQPWSSPFFHKTAETVPQVTVKSFQHDTQNSELLIASIFKGHLTSDNRQQDIGLLLGMIFFAAMLSILSLIGIFNRSIRTGIKRRILLLIPKWLHEDIPNMENSKVVEMLQKQSEFMNNNSSEQVLYADPVITEIEIFLPEEHKPTDYKAEKNTGSLETRDCLQNSLLTNTTVVYIPGLSTGYKPQISNFLTGGNHLSKKDETSSSTLKPLADSSDLGGNARFKKYPNFAFSVSSMNSLSNTLFLEELSLILNQGERSPLDMQNSVEGETTMLLENASPNETIPEQTLLPDEFVSCLGIMNEELPSINSYFPQNILENHFNTISLLEK

SEQ ID NO: 765 - protein, 630 aa, Bos sp.
MNQVTIHWDVVIALYIFFSWCHGGITNINCSGHIWVEPATIFKMGMNISIYCQAAIKNCQPSKLYFYKNGIKERFHITRINKTTARLWYNNFVEPQAFMYCTAECSRYFPETLICGKDISSGYPPDVPDKVACVIYEYSGNMTCTWNPGRPTYIDTKYVVYVKSLETEEEQEYLTSSYINISTDSLQKGKKYLVWVQASNVLGMEKSKQLQIHLDDIVIPSASIISRAEDINTTVSKTVIHWDSQTSIEKVSCEMRYKATTNQTWNVKEFDTNFTYEQQSEFYLQPNAMYVFQVRCQETGKKYWQPWSSPFFHKTPEIVPQVTMKSFQHDTQNSGLLIASIFKKHLTSDNRKQDIGLLLGMVFFAVMLSVLSLIGIFNRSLRTGIKRRILLLIPKWLYEDIPNMENSKVVKILQERNEFMNNNSSEQVLYVDPVITEIEIILPEEKPMGYKKENNTGCLERKESLEKSLLTDTTVVYIPDLNTGYKPQISSFLPGGNHLSNDDETASSILEPPADSLNLGNNARFKKYPDFAFSVSSTNSLSNTLFLEELNLILNQGECSPPDMQNSIEGETAMLLEDDLLNETIPEQTLLPDEFVSCLGSMNKELPSINSYFPQNILESHFNRISLLEK

SEQ ID NO: 766 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Lys(Ac)
XQTWQCFXLKNN

SEQ ID NO: 767 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQCFXXKNG

SEQ ID NO: 768-779 - skipped (12 entries)

SEQ ID NO: 780 - protein, 12 aa, Artificial Sequence
  Description of Artificial Sequence: Synthetic peptide
  MOD_RES (1)..(1): Abu
  MOD_RES (7)..(7): Phe(4-tBu)
  MOD_RES (9)..(9): alpha-MeLys
XQTWQCFWKENG

SEQ ID NO: 781 - protein, 12 aa, Artificial Sequence
  Description of Artificial Sequence: Synthetic peptide
  MOD_RES (1)..(1): Abu
  MOD_RES (7)..(7): Phe(4-guanidino)
  MOD_RES (9)..(9): alpha-MeLys
XQTWQCFWKENG

SEQ ID NO: 782 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
XQTWQCFWKENG

SEQ ID NO: 783 - protein, 12 aa, Artificial Sequence
  Description of Artificial Sequence: Synthetic peptide
  MOD_RES (1)..(1): Abu
  MOD_RES (7)..(7): Phe(4-CO2H)
  MOD_RES (9)..(9): alpha-MeLys
XQTWQCFWKENG

SEQ ID NO: 784 - protein, 12 aa, Artificial Sequence
  Description of Artificial Sequence: Synthetic peptide
  MOD_RES (1)..(1): Abu
  MOD_RES (7)..(7): Phe(4-phenoxy)
  MOD_RES (9)..(9): alpha-MeLys
XQTWQCFWKENG

SEQ ID NO: 785 - protein, 12 aa, Artificial Sequence
  Description of Artificial Sequence: Synthetic peptide
  MOD_RES (1)..(1): Abu
  MOD_RES (7)..(7): Phe(4-CN)
  MOD_RES (9)..(9): alpha-MeLys
XQTWQCFWKENG

SEQ ID NO: 786 - protein, 12 aa, Artificial Sequence
  Description of Artificial Sequence: Synthetic peptide
  MOD_RES (1)..(1): Abu
  MOD_RES (7)..(7): Phe(4-Br)
  MOD_RES (9)..(9): alpha-MeLys
XQTWQCFWKENG

SEQ ID NO: 787 - protein, 12 aa, Artificial Sequence
  Description of Artificial Sequence: Synthetic peptide
  MOD_RES (1)..(1): Abu
  MOD_RES (7)..(7): Phe(4-NH2)
  MOD_RES (9)..(9): alpha-MeLys
XQTWQCFWKENG

SEQ ID NO: 788 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Phe(4-Me)
  MOD_RES (9)..(9): alpha-MeLys
XQTWQCFFKENG

SEQ ID NO: 789 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 1-Nal
  MOD_RES (9)..(9): alpha-MeLys
XQTWQCFXKENG

SEQ ID NO: 790 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeOrn
  MOD_RES (10)..(10): Lys(Ac)
XQTWQCFXXKNG

SEQ ID NO: 791 - protein, 12 aa, Artificial Sequence
  Description of Artificial Sequence: Synthetic peptide
  MOD_RES (1)..(1): Abu
  MOD_RES (7)..(7): 2-Nal
  MOD_RES (8)..(8): 2-Nal
  MOD_RES (9)..(9): alpha-MeOrn
  MOD_RES (10)..(10): Lys(Ac)
XQTWQCXXXKNG

SEQ ID NO: 792 - protein, 12 aa, Artificial Sequence
  Description of Artificial Sequence: Synthetic peptide
  MOD_RES (1)..(1): Abu
  MOD_RES (7)..(7): Bip
  MOD_RES (8)..(8): 2-Nal
  MOD_RES (9)..(9): alpha-MeLys
  MOD_RES (10)..(10): Lys(Ac)
XQTWQCXXKKNG

SEQ ID NO: 793 - protein, 12 aa, Artificial Sequence
  Description of Artificial Sequence: Synthetic peptide
  MOD_RES (1)..(1): Abu
  MOD_RES (7)..(7): Cha
  MOD_RES (8)..(8): 2-Nal
  MOD_RES (9)..(9): alpha-MeLys
  MOD_RES (10)..(10): Lys(Ac)
XQTWQCXXKKNG

SEQ ID NO: 794 - protein, 12 aa, Artificial Sequence
  Description of Artificial Sequence: Synthetic peptide
  MOD_RES (1)..(1): Abu
  MOD_RES (7)..(7): 2-Nal
  MOD_RES (8)..(8): 2-Nal
  MOD_RES (9)..(9): alpha-MeLys
  MOD_RES (10)..(10): Lys(Ac)
XQTWQCXXKKNG

SEQ ID NO: 795 - protein, 12 aa, Artificial Sequence
  Description of Artificial Sequence: Synthetic peptide
  MOD_RES (1)..(1): Abu
  MOD_RES (7)..(7): 4-Pyridylalanine
  MOD_RES (8)..(8): 2-Nal
  MOD_RES (9)..(9): alpha-MeLys
  MOD_RES (10)..(10): Lys(Ac)
XQTWQCAXKKNG

SEQ ID NO: 796 - protein, 12 aa, Artificial Sequence
  Description of Artificial Sequence: Synthetic peptide
  MOD_RES (1)..(1): Abu
  MOD_RES (7)..(7): Beta-homoTyr
  MOD_RES (8)..(8): 2-Nal
  MOD_RES (9)..(9): alpha-MeLys
  MOD_RES (10)..(10): Lys(Ac)
XQTWQCYXKKNG

SEQ ID NO: 797 - protein, 12 aa, Artificial Sequence
  Description of Artificial Sequence: Synthetic peptide
  MOD_RES (1)..(1): Abu
  MOD_RES (7)..(7): Phe(4-CONH2)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 798 - protein, 12 aa, Artificial Sequence
  Description of Artificial Sequence: Synthetic peptide
  MOD_RES (1)..(1): Abu
  MOD_RES (7)..(7): 2-Nal
  MOD_RES (8)..(8): 2-Nal
  MOD_RES (9)..(9): alpha-MeLys
XQTWQCXXKENG

SEQ ID NO: 799 - protein, 12 aa, Artificial Sequence
  Description of Artificial Sequence: Synthetic peptide
  MOD_RES (1)..(1): Abu
  MOD_RES (4)..(4): 2-Nal
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTXQCFXKKNG

SEQ ID NO: 800 - protein, 12 aa, Artificial Sequence
  Description of Artificial Sequence: Synthetic peptide
  MOD_RES (1)..(1): Abu
  MOD_RES (4)..(4): 1-Nal
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTXQCFXKKNG

SEQ ID NO: 801 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTYQCFXKKNG

SEQ ID NO: 802 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 803 - protein, 14 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNGGE

SEQ ID NO: 804 - protein, 14 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNGAE

SEQ ID NO: 805 - protein, 14 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XSTWQCFXKKNGGE

SEQ ID NO: 806 - protein, 14 aa, Artificial Sequence
  Description of Artificial Sequence: Synthetic peptide
  MOD_RES (1)..(1): Abu
  MOD_RES (7)..(7): Phe(4-OMe)
  MOD_RES (9)..(9): alpha-MeLys
  MOD_RES (10)..(10): Lys(Ac)
XQTWQCFWKKNGGE

SEQ ID NO: 807 - protein, 14 aa, Artificial Sequence
  Description of Artificial Sequence: Synthetic peptide
  MOD_RES (1)..(1): Abu
  MOD_RES (8)..(8): 2-Nal
  MOD_RES (9)..(9): alpha-MeLys
  MOD_RES (10)..(10): Lys(Ac)
XQTWQCYXKKNGGE

SEQ ID NO: 808 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNS

SEQ ID NO: 809 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNA

SEQ ID NO: 810 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): Aib
  MOD_RES (10)..(10): Lys(Ac)
XQTWQCFXXKNG

SEQ ID NO: 811 - protein, 12 aa, Artificial Sequence
  Description of Artificial Sequence: Synthetic peptide
  MOD_RES (1)..(1): Abu
  MOD_RES (7)..(7): Phe-4-N3
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 812 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKQG

SEQ ID NO: 813 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
  MOD_RES (11)..(11): Cit
XQTWQCFXKKXG

SEQ ID NO: 814 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKVNG

SEQ ID NO: 815 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): Orn
  MOD_RES (10)..(10): Lys(Ac)
XQTWQCFXXKNG

SEQ ID NO: 816 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): Orn
  MOD_RES (10)..(10): Dap
XQTWQCFXXXNG

SEQ ID NO: 817 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XNTWQCFXKKNG

SEQ ID NO: 818 - protein, 12 aa, Artificial Sequence
  Description of Artificial Sequence: Synthetic peptide
  MOD_RES (1)..(1): Abu
  MOD_RES (4)..(4): Bip
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTXQCFXKKNG

SEQ ID NO: 819 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): Cha
  MOD_RES (10)..(10): Lys(Ac)
XQTWQCFXXKNG

SEQ ID NO: 820 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): Chg
  MOD_RES (10)..(10): Lys(Ac)
XQTWQCFXXKNG

SEQ ID NO: 821 - protein, 12 aa, Artificial Sequence
  Description of Artificial Sequence: Synthetic peptide
  MOD_RES (1)..(1): Abu
  MOD_RES (4)..(4): Octgly
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTGQCFXKKNG

SEQ ID NO: 822 - protein, 12 aa, Artificial Sequence
  Description of Artificial Sequence: Synthetic peptide
  MOD_RES (1)..(1): Abu
  MOD_RES (7)..(7): Octgly
  MOD_RES (8)..(8): 2-Nal
  MOD_RES (9)..(9): alpha-MeLys
  MOD_RES (10)..(10): Lys(Ac)
XQTWQCGXKKNG

SEQ ID NO: 823 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): Octgly
  MOD_RES (9)..(9): alpha-MeLys
  MOD_RES (10)..(10): Lys(Ac)
XQTWQCFGKKNG

SEQ ID NO: 824 - protein, 13 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNGE

SEQ ID NO: 825 - protein, 13 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQCFXKKNAE

SEQ ID NO: 826 - protein, 13 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XSTWQCFXKKNGE

SEQ ID NO: 827 - protein, 13 aa, Artificial Sequence
  Description of Artificial Sequence: Synthetic peptide
  MOD_RES (1)..(1): Abu
  MOD_RES (7)..(7): Phe(4-OMe)
  MOD_RES (9)..(9): alpha-MeLys
  MOD_RES (10)..(10): Lys(Ac)
XQTWQCFWKKNGE

SEQ ID NO: 828 - protein, 13 aa, Artificial Sequence
  Description of Artificial Sequence: Synthetic peptide
  MOD_RES (1)..(1): Abu
  MOD_RES (8)..(8): 2-Nal
  MOD_RES (9)..(9): alpha-MeLys
  MOD_RES (10)..(10): Lys(Ac)
XQTWQCYXKKNGE

SEQ ID NO: 829 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKENG

SEQ ID NO: 830 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTQQCFXKENG

SEQ ID NO: 831 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTHQCFXKENG

SEQ ID NO: 832 - protein, 12 aa, Artificial Sequence
  Description of Artificial Sequence: Synthetic peptide
  MOD_RES (1)..(1): Abu
  MOD_RES (4)..(4): hPhe
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 833 - protein, 12 aa, Artificial Sequence
  Description of Artificial Sequence: Synthetic peptide
  MOD_RES (1)..(1): Abu
  MOD_RES (4)..(4): Glu(Bzl)
  MOD_RES (7)..(7): Phe[4-(2-aminoethoxy)]
  MOD_RES (8)..(8): 2-Nal
  MOD_RES (9)..(9): alpha-MeLys
XQTEQCFXKENG

SEQ ID NO: 834 - protein, 12 aa, Artificial Sequence
  Description of Artificial Sequence: Synthetic peptide
  MOD_RES (1)..(1): Abu
  MOD_RES (4)..(4): Bip
  MOD_RES (7)..(7): Phe[4-(2-aminoethoxy)]
  MOD_RES (8)..(8): 2-Nal
  MOD_RES (9)..(9): alpha-MeLys
XQTXQCFXKENG

SEQ ID NO: 835 - protein, 12 aa, Artificial Sequence
  Description of Artificial Sequence: Synthetic peptide
  MOD_RES (1)..(1): Abu
  MOD_RES (4)..(4): Tic
  MOD_RES (7)..(7): Phe[4-(2-aminoethoxy)]
  MOD_RES (8)..(8): 2-Nal
  MOD_RES (9)..(9): alpha-MeLys
XQTXQCFXKENG

SEQ ID NO: 836 - protein, 12 aa, Artificial Sequence
  Description of Artificial Sequence: Synthetic peptide
  MOD_RES (1)..(1): Abu
  MOD_RES (4)..(4): Phe[4-(2-aminoethoxy)]
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 837 - protein, 12 aa, Artificial Sequence
  Description of Artificial Sequence: Synthetic peptide
  MOD_RES (1)..(1): Abu
  MOD_RES (4)..(4): Phe(3,4-Cl2)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 838 - protein, 12 aa, Artificial Sequence
  Description of Artificial Sequence: Synthetic peptide
  MOD_RES (1)..(1): Abu
  MOD_RES (4)..(4): Phe(4-OMe)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 839 - protein, 12 aa, Artificial Sequence
  Description of Artificial Sequence: Synthetic peptide
  MOD_RES (1)..(1): Abu
  MOD_RES (4)..(4): Orn(Benzyl)
  MOD_RES (7)..(7): Phe[4-(2-aminoethoxy)]
  MOD_RES (8)..(8): 2-Nal
  MOD_RES (9)..(9): alpha-MeLys
XQTXQCFXKENG

SEQ ID NO: 840 - protein, 12 aa, Artificial Sequence
  Description of Artificial Sequence: Synthetic peptide
  MOD_RES (1)..(1): Abu
  MOD_RES (4)..(4): Orn(Benzaldehyde)
  MOD_RES (7)..(7): Phe[4-(2-aminoethoxy)]
  MOD_RES (8)..(8): 2-Nal
  MOD_RES (9)..(9): alpha-MeLys
XQTXQCFXKENG

SEQ ID NO: 841 - protein, 12 aa, Artificial Sequence
  Description of Artificial Sequence: Synthetic peptide
  MOD_RES (1)..(1): Abu
  MOD_RES (7)..(7): Phe-OCH2CH2NHAc
  MOD_RES (8)..(8): 2-Nal
  MOD_RES (9)..(9): alpha-MeLys
XQTWQCFXKENG

SEQ ID NO: 842 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLENG

SEQ ID NO: 843 - protein, 12 aa, Artificial Sequence
  Description of Artificial Sequence: Synthetic peptide
  MOD_RES (1)..(1): Abu
  MOD_RES (4)..(4): 5-hydroxyTrp
  MOD_RES (7)..(7): Phe[4-(2-aminoethoxy)]
  MOD_RES (8)..(8): 2-Nal
  MOD_RES (9)..(9): alpha-MeLys
XQTWQCFXKENG

SEQ ID NO: 844 - protein, 12 aa, Artificial Sequence
  Description of Artificial Sequence: Synthetic peptide
  MOD_RES (1)..(1): Abu
  MOD_RES (4)..(4): 6-chloroTrp
  MOD_RES (7)..(7): Phe[4-(2-aminoethoxy)]
  MOD_RES (8)..(8): 2-Nal
  MOD_RES (9)..(9): alpha-MeLys
XQTWQCFXKENG

SEQ ID NO: 845 - protein, 12 aa, Artificial Sequence
  Description of Artificial Sequence: Synthetic peptide
  MOD_RES (1)..(1): Abu
  MOD_RES (4)..(4): N-MeTrp
  MOD_RES (7)..(7): Phe[4-(2-aminoethoxy)]
  MOD_RES (8)..(8): 2-Nal
  MOD_RES (9)..(9): alpha-MeLys
XQTWQCFXKENG

SEQ ID NO: 846 - protein, 12 aa, Artificial Sequence
  Description of Artificial Sequence: Synthetic peptide
  MOD_RES (1)..(1): Abu
  MOD_RES (4)..(4): 1,2,3,4-tetrahydro-norharman
  MOD_RES (7)..(7): Phe[4-(2-aminoethoxy)]
  MOD_RES (8)..(8): 2-Nal
  MOD_RES (9)..(9): alpha-MeLys
XQTXQCFXKENG

SEQ ID NO: 847 - protein, 12 aa, Artificial Sequence
  Description of Artificial Sequence: Synthetic peptide
  MOD_RES (1)..(1): Abu
  MOD_RES (4)..(4): Phe(4-CO2H)
  MOD_RES (7)..(7): Phe[4-(2-aminoethoxy)]
  MOD_RES (8)..(8): 2-Nal
  MOD_RES (9)..(9): alpha-MeLys]
XQTFQCFXKENG

SEQ ID NO: 848 - protein, 12 aa, Artificial Sequence
  Description of Artificial Sequence: Synthetic peptide
  MOD_RES (1)..(1): Abu
  MOD_RES (4)..(4): Phe(4-CONH2)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 849 - protein, 12 aa, Artificial Sequence
  Description of Artificial Sequence: Synthetic peptide
  MOD_RES (1)..(1): Abu
  MOD_RES (4)..(4): Phe(4-CONH2)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 850 - protein, 12 aa, Artificial Sequence
  Description of Artificial Sequence: Synthetic peptide
  MOD_RES (1)..(1): Abu
  MOD_RES (4)..(4): Phe(3,4-OMe)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 851 - protein, 12 aa, Artificial Sequence
  Description of Artificial Sequence: Synthetic peptide
  MOD_RES (1)..(1): Abu
  MOD_RES (4)..(4): alpha-MePhe
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 852 - protein, 12 aa, Artificial Sequence
  Description of Artificial Sequence: Synthetic peptide
  MOD_RES (1)..(1): Abu
  MOD_RES (4)..(4): Phe(4-CF3)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 853 - protein, 12 aa, Artificial Sequence
  Description of Artificial Sequence: Synthetic peptide
  MOD_RES (1)..(1): Abu
  MOD_RES (4)..(4): Phe(4-tBu)
  MOD_RES (7)..(7): Phe[4-(2-aminoethoxy)]
  MOD_RES (8)..(8): 2-Nal
  MOD_RES (9)..(9): alpha-MeLys]
XQTFQCFXKENG

SEQ ID NO: 854 - protein, 12 aa, Artificial Sequence
  Description of Artificial Sequence: Synthetic peptide
  MOD_RES (1)..(1): Abu
  MOD_RES (4)..(4): Phe(2,4-Me2)
  MOD_RES (7)..(7): Phe[4-(2-aminoethoxy)]
  MOD_RES (8)..(8): 2-Nal
  MOD_RES (9)..(9): alpha-MeLys
XQTFQCFXKENG

SEQ ID NO: 855 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKDNG

SEQ ID NO: 856 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKQNG

SEQ ID NO: 857 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Benzoic acid)
XQTWQCFXKKNG

SEQ ID NO: 858 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(succinic acid)
XQTWQCFXKKNG

SEQ ID NO: 859 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(glutaric acid)
XQTWQCFXKKNG

SEQ ID NO: 860 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(pyroglutamic acid) conjugated through side chain
XQTWQCFXKKNG

SEQ ID NO: 861 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(isovaleric acid)
XQTWQCFXKKNG

SEQ ID NO: 862 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Palm)
XQTWQCFXKKNG

SEQ ID NO: 863 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(PEG1)
XQTWQCFXKKNG

SEQ ID NO: 864 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(PEG2)
XQTWQCFXKKNG

SEQ ID NO: 865 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(Benzoic acid)
XQTWQCFXKXNG

SEQ ID NO: 866 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(succinic acid)
XQTWQCFXKXNG

SEQ ID NO: 867 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(glutaric acid)
XQTWQCFXKXNG

SEQ ID NO: 868 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(pyroglutamic acid) conjugated through side chain
XQTWQCFXKXNG

SEQ ID NO: 869 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(IVA)
XQTWQCFXKXNG

SEQ ID NO: 870 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(PEG1)
XQTWQCFXKXNG

SEQ ID NO: 871 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(PEG2)
XQTWQCFXKXNG

SEQ ID NO: 872 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Dap(PEG2-Ac)
XQTWQCFXKXNG

SEQ ID NO: 873 - protein, 14 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (13)..(13): (2-aminoethoxy)acetic acid
  MOD_RES (14)..(14): D-Lys
XQTWQCFXKKNGXK

SEQ ID NO: 874 - protein, 13 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (13)..(13): D-Lys
XQTWQCFXKKNGK

SEQ ID NO: 875 - protein, 13 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (13)..(13): (2-aminoethoxy)acetic acid
XQTWQCFXKKNGX

SEQ ID NO: 876 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQCFXXKQG

SEQ ID NO: 877 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
XQTWQCFXXQNG

SEQ ID NO: 878 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
XQTWQCFXXENG

SEQ ID NO: 879 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 1-Nal
  MOD_RES (9)..(9): Aib
  MOD_RES (10)..(10): Lys(Ac)
XQTWQCFXXKNG

SEQ ID NO: 880 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQCFXXKNA

SEQ ID NO: 881 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
XQTWQCFXXKNG

SEQ ID NO: 882 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): Phe(4-CO2H)
  MOD_RES (9)..(9): alpha-MeLys
  MOD_RES (10)..(10): Lys(Ac)
XQTWQCFFKKNG

SEQ ID NO: 883 - protein, 12 aa, Artificial Sequence
  Description of Artificial Sequence: Synthetic peptide
  MOD_RES (1)..(1): Abu
  MOD_RES (2)..(2): Dap
  MOD_RES (7)..(7): Phe[4-(2-aminoethoxy)]
  MOD_RES (8)..(8): Phe(4-Phenoxy)
  MOD_RES (9)..(9): alpha-MeLys
  MOD_RES (10)..(10): Lys(Ac)
XXTWQCFFKKNG

SEQ ID NO: 884 - protein, 12 aa, Artificial Sequence
  Description of Artificial Sequence: Synthetic peptide
  MOD_RES (1)..(1): Abu
  MOD_RES (2)..(2): Dap
  MOD_RES (7)..(7): Phe[4-(2-aminoethoxy)]
  MOD_RES (8)..(8): Phe[4-(2-aminoethoxy)]
  MOD_RES (9)..(9): alpha-MeLys
  MOD_RES (10)..(10): Lys(Ac)
XXTWQCFFKKNG

SEQ ID NO: 885 - protein, 11 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): alpha-MeLys
  MOD_RES (9)..(9): Lys(Ac)
XQTWQCFKKNG

SEQ ID NO: 886 - protein, 12 aa, Artificial Sequence
  Description of Artificial Sequence: Synthetic peptide
  MOD_RES (1)..(1): Abu
  MOD_RES (2)..(2): Dab
  MOD_RES (7)..(7): Phe[4-(2-aminoethoxy)]
  MOD_RES (8)..(8): hPhe
  MOD_RES (9)..(9): alpha-MeLys
  MOD_RES (10)..(10): Lys(Ac)
XXTWQCFFKKNG

SEQ ID NO: 887 - protein, 12 aa, Artificial Sequence
  Description of Artificial Sequence: Synthetic peptide
  MOD_RES (1)..(1): Abu
  MOD_RES (2)..(2): Dap
  MOD_RES (7)..(7): Phe[4-(2-aminoethoxy)]
  MOD_RES (8)..(8): Glu(Bzl)
  MOD_RES (9)..(9): alpha-MeLys
  MOD_RES (10)..(10): Lys(Ac)
XXTWQCFEKKNG

SEQ ID NO: 888 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-Me-Orn
XQTWQCFWXENG

SEQ ID NO: 889 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
  MOD_RES (10)..(10): Lys(Ac)
XQTWQCFWKKNG

SEQ ID NO: 890 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-Me-Orn
  MOD_RES (10)..(10): Lys(Ac)
XQTWQCFWXKNG

SEQ ID NO: 891 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-Me-Orn
  MOD_RES (10)..(10): Lys(Ac)
XQTWQCFXXKNG

SEQ ID NO: 892 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 893 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Orn
  MOD_RES (10)..(10): Lys(Ac)
XQTWQCFXXKNG

SEQ ID NO: 894 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): Orn
XQTWQCFWXENG

SEQ ID NO: 895 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): Orn
  MOD_RES (10)..(10): Dap
XQTWQCFWXXNG

SEQ ID NO: 896 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): Orn
  MOD_RES (10)..(10): Dap(Ac)
XQTWQCFWXXNG

SEQ ID NO: 897 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Orn
  MOD_RES (10)..(10): Dap
XQTWQCFXXXNG

SEQ ID NO: 898 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Orn
  MOD_RES (10)..(10): Dap(Ac)
XQTWQCFXXXNG

SEQ ID NO: 899 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): hLeu
XQTWQCFWLENG

SEQ ID NO: 900 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
  MOD_RES (10)..(10): Lys(Ac)
XQTWQCFXKKNG

SEQ ID NO: 901 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-Me-Leu
XQTWQCFWLENG

SEQ ID NO: 902 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 903 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
  MOD_RES (10)..(10): Lys(Ac)
  MOD_RES (11)..(11): Dap
XQTWQCFWKKXG

SEQ ID NO: 904 - protein, 10 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
  MOD_RES (10)..(10): Lys(Ac)
XQTWQCFWKK

SEQ ID NO: 905 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): Chg
  MOD_RES (10)..(10): Lys(Ac)
XQTWQCFWXKNG

SEQ ID NO: 906 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
XQTWQCFXKENG

SEQ ID NO: 907 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): Phe(4-CONH2)
  MOD_RES (9)..(9): alpha-MeLys
  MOD_RES (10)..(10): Lys(Ac)
XQTWQCFFKKNG

SEQ ID NO: 908 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): Phe(3,4-OMe2)
  MOD_RES (9)..(9): alpha-MeLys
  MOD_RES (10)..(10): Lys(Ac)
XQTWQCFFKKNG

SEQ ID NO: 909 - protein, 12 aa, Artificial Sequence
  Description of Artificial Sequence: Synthetic peptide
  MOD_RES (1)..(1): Abu
  MOD_RES (2)..(2): Dap
  MOD_RES (7)..(7): Phe[4-(2-aminoethoxy)]
  MOD_RES (8)..(8): Tic
  MOD_RES (9)..(9): alpha-MeLys
  MOD_RES (10)..(10): Lys(Ac)
XXTWQCFXKKNG

SEQ ID NO: 910 - protein, 12 aa, Artificial Sequence
  Description of Artificial Sequence: Synthetic peptide
  MOD_RES (1)..(1): Abu
  MOD_RES (2)..(2): Dap
  MOD_RES (7)..(7): Phe[4-(2-aminoethoxy)]
  MOD_RES (8)..(8): Phe(3,4-Cl2)
  MOD_RES (9)..(9): alpha-MeLys
  MOD_RES (10)..(10): Lys(Ac)
XXTWQCFFKKNG

SEQ ID NO: 911 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKENQ

SEQ ID NO: 912 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKENN

SEQ ID NO: 913 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XTTWQCFXKENG

SEQ ID NO: 914 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-Me-Gly(Ethyl)
  MOD_RES (10)..(10): Lys(Ac)
XQTWQCFXGKNG

SEQ ID NO: 915 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeVal
  MOD_RES (10)..(10): Lys(Ac)
XQTWQCFXVKNG

SEQ ID NO: 916 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeSer
  MOD_RES (10)..(10): Lys(Ac)
XQTWQCFXSKNG

SEQ ID NO: 917 - protein, 12 aa, Artificial Sequence
  Description of Artificial Sequence: Synthetic peptide
  MOD_RES (1)..(1): Abu
  MOD_RES (4)..(4): Dap
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTXQCFXKKNG

SEQ ID NO: 918 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): Dap
  MOD_RES (9)..(9): alpha-MeLys
  MOD_RES (10)..(10): Lys(Ac)
XQTWQCFXKKNG

SEQ ID NO: 919 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTRQCFXKKNG

SEQ ID NO: 920 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
  MOD_RES (10)..(10): Lys(Ac)
XQTWQCFRKKNG

SEQ ID NO: 921 - protein, 12 aa, Artificial Sequence
  Description of Artificial Sequence: Synthetic peptide
  MOD_RES (1)..(1): Abu
  MOD_RES (4)..(4): Dap
  MOD_RES (7)..(7): Phe[4-(2-aminoethoxy)]
  MOD_RES (8)..(8): Dap
  MOD_RES (9)..(9): alpha-MeLys
  MOD_RES (10)..(10): Lys(Ac)
XQTXQCFXKKNG

SEQ ID NO: 922 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTDQCFXKKNG

SEQ ID NO: 923 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
  MOD_RES (10)..(10): Lys(Ac)
XQTWQCFDKKNG

SEQ ID NO: 924 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): alpha-MeLys
  MOD_RES (10)..(10): Lys(Ac)
XQTDQCFDKKNG

SEQ ID NO: 925 - protein, 13 aa, Artificial Sequence
  Description of Artificial Sequence: Synthetic peptide
  MOD_RES (1)..(1): D-Lys
  MOD_RES (2)..(2): Abu
  MOD_RES (8)..(8): Phe(4-OMe)
  MOD_RES (9)..(9): 2-Nal
  MOD_RES (10)..(10): alpha-MeLeu
KXQTWQCFXLENG

SEQ ID NO: 926 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKRNG

SEQ ID NO: 927 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Orn
XQTWQCFXKXNG

SEQ ID NO: 928 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKKNG

SEQ ID NO: 929 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): hArg
XQTWQCFXKRNG

SEQ ID NO: 930 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): hLeu
  MOD_RES (10)..(10): Lys(Ac)
  MOD_RES (12)..(12): Beta-Ala
XQTWQCFXLKNA

SEQ ID NO: 931 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Cit
  MOD_RES (10)..(10): Dap
XQTWQCFXXXNG

SEQ ID NO: 932 - protein, 12 aa, Artificial Sequence
  Description of Artificial Sequence: Synthetic peptide
  MOD_RES (1)..(1): Abu
  MOD_RES (2)..(2): alpha-Me-Orn
  MOD_RES (7)..(7): Phe[4-(2-aminoethoxy)]
  MOD_RES (8)..(8): 2-Nal
  MOD_RES (9)..(9): alpha-MeLys
XXTWQCFXKENG

SEQ ID NO: 933 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XQTWQCFXKNNG

SEQ ID NO: 934 - protein, 14 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
XSTWQCFXKKNGGE

SEQ ID NO: 935 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
XQTWQCFXKENQ

SEQ ID NO: 936 - protein, 12 aa, Artificial Sequence
  Description of Artificial Sequence: Synthetic peptide
  MOD_RES (1)..(1): Abu
  MOD_RES (7)..(7): Phe[4-(2-(acetyl-aminoethoxy)]
  MOD_RES (8)..(8): 2-Nal
  MOD_RES (9)..(9): alpha-MeLys(Ac)
XQTWQCFXKENN

SEQ ID NO: 937 - protein, 11 aa, Artificial Sequence
  Description of Artificial Sequence: Synthetic peptide
  MOD_RES (1)..(1): Abu
  MOD_RES (6)..(6): Phe[4-(2-aminoethoxy)]
  MOD_RES (7)..(7): 2-Nal
  MOD_RES (8)..(8): alpha-MeLys
XTWQCFXKENG

SEQ ID NO: 938 - protein, 12 aa, Artificial Sequence
  Description of Artificial Sequence: Synthetic peptide
  MOD_RES (1)..(1): Abu
  MOD_RES (7)..(7): Phe(4-Me)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 939 - protein, 12 aa, Artificial Sequence
  Description of Artificial Sequence: Synthetic peptide
  MOD_RES (1)..(1): Abu
  MOD_RES (7)..(7): Phe(3-Me)
  MOD_RES (8)..(8): 2-Nal
  MOD_RES (9)..(9): alpha-MeLys
  MOD_RES (10)..(10): Lys(Ac)
XQTWQCFXKKNG

SEQ ID NO: 940 - protein, 12 aa, Artificial Sequence
  Description of Artificial Sequence: Synthetic peptide
  MOD_RES (1)..(1): Abu
  MOD_RES (7)..(7): hTyr
  MOD_RES (8)..(8): 2-Nal
  MOD_RES (9)..(9): alpha-MeLys
  MOD_RES (10)..(10): Lys(Ac)
XQTWQCYXKKNG

SEQ ID NO: 941 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): alpha-MeTrp
  MOD_RES (9)..(9): alpha-MeLys
  MOD_RES (10)..(10): Lys(Ac)
XQTWQCFWKKNG

SEQ ID NO: 942 - protein, 12 aa, Artificial Sequence
  Description of Artificial Sequence: Synthetic peptide
  MOD_RES (1)..(1): Abu
  MOD_RES (2)..(2): alpha-MeSer
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XSTWQCFXKKNG

SEQ ID NO: 943 - protein, 12 aa, Artificial Sequence
  Description of Artificial Sequence: Synthetic peptide
  MOD_RES (1)..(1): Abu
  MOD_RES (3)..(3): alpha-MeSer
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQSWQCFXKKNG

SEQ ID NO: 944 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): alpha-MePhe
  MOD_RES (9)..(9): alpha-MeLys
  MOD_RES (10)..(10): Lys(Ac)
XQTWQCFFKKNG

SEQ ID NO: 945 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): Aib
XQTWQCFWXENG

SEQ ID NO: 946 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (10)..(10): Lys(Ac)
XQTWQCFXXKNG

SEQ ID NO: 947 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (11)..(11): Dap(Ac)
XQTWQCFXXEXG

SEQ ID NO: 948 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (11)..(11): Dab(Ac)
XQTWQCFXXEXG

SEQ ID NO: 949 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (11)..(11): Lys(Ac)
XQTWQCFXXEKG

SEQ ID NO: 950 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (9)..(9): Aib
XQTWQCFWXENN

SEQ ID NO: 951 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLENN

SEQ ID NO: 952 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): Phe(3,4-OMe2)
  MOD_RES (9)..(9): Aib
XQTWQCFFXENG

SEQ ID NO: 953 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): Phe(3,4-Cl2)
  MOD_RES (9)..(9): Aib
XQTWQCFFXENN

SEQ ID NO: 954 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Cit
XQTWQCFXLXNN

SEQ ID NO: 955 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Lys(Ac)
XQTWQCFXLKNN

SEQ ID NO: 956 - protein, 12 aa, Artificial Sequence
  Description of Artificial Sequence: Synthetic peptide
  MOD_RES (1)..(1): Abu
  MOD_RES (7)..(7): Phe(4-Me)
  MOD_RES (8)..(8): 2-Nal
  MOD_RES (9)..(9): Aib
XQTWQCFXXENG

SEQ ID NO: 957 - protein, 12 aa, Artificial Sequence
  Description of Artificial Sequence: Synthetic peptide
  MOD_RES (1)..(1): Abu
  MOD_RES (7)..(7): Phe(3,4-F2)
  MOD_RES (8)..(8): 2-Nal
  MOD_RES (9)..(9): Aib
XQTWQCFXXENG

SEQ ID NO: 958 - protein, 12 aa, Artificial Sequence
  Description of Artificial Sequence: Synthetic peptide
  MOD_RES (1)..(1): Abu
  MOD_RES (7)..(7): Phe(3-CONH2)
  MOD_RES (8)..(8): 2-Nal
  MOD_RES (9)..(9): Aib
XQTWQCFXXENG

SEQ ID NO: 959 - protein, 12 aa, Artificial Sequence
  Description of Artificial Sequence: Synthetic peptide
  MOD_RES (1)..(1): Abu
  MOD_RES (7)..(7): Phe(2,4-Cl2)
  MOD_RES (8)..(8): 2-Nal
  MOD_RES (9)..(9): Aib
XQTWQCFXXENG

SEQ ID NO: 960 - protein, 12 aa, Artificial Sequence
  Description of Artificial Sequence: Synthetic peptide
  MOD_RES (1)..(1): Abu
  MOD_RES (7)..(7): Phe(3-Me)
  MOD_RES (8)..(8): 2-Nal
  MOD_RES (9)..(9): Aib
XQTWQCFXXENG

SEQ ID NO: 961 - protein, 12 aa, Artificial Sequence
  Description of Artificial Sequence: Synthetic peptide
  MOD_RES (1)..(1): Abu
  MOD_RES (7)..(7): Phe(4-Cl)
  MOD_RES (8)..(8): 2-Nal
  MOD_RES (9)..(9): Aib
XQTWQCFXXENG

SEQ ID NO: 962 - protein, 12 aa, Artificial Sequence
  Description of Artificial Sequence: Synthetic peptide
  MOD_RES (1)..(1): Abu
  MOD_RES (7)..(7): Phe(4-F)
  MOD_RES (8)..(8): 2-Nal
  MOD_RES (9)..(9): Aib
XQTWQCFXXENG

SEQ ID NO: 963 - protein, 12 aa, Artificial Sequence
  Description of Artificial Sequence: Synthetic peptide
  MOD_RES (1)..(1): Abu
  MOD_RES (7)..(7): Phe(2,4-Cl2, 4-OBz)
  MOD_RES (8)..(8): 2-Nal
  MOD_RES (9)..(9): Aib
XQTWQCFXXENG

SEQ ID NO: 964 - protein, 13 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLeu
  MOD_RES (13)..(13): D-Lys
XQTWQCFXLENGK

SEQ ID NO: 965 - protein, 13 aa, Artificial Sequence
  Description of Artificial Sequence: Synthetic peptide
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
EXQTWQCFXKENN

SEQ ID NO: 966 - protein, 13 aa, Artificial Sequence
  Description of Artificial Sequence: Synthetic peptide
  MOD_RES (1)..(1): D-Glu
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
EXQTWQCFXKENN

SEQ ID NO: 967 - protein, 13 aa, Artificial Sequence
  Description of Artificial Sequence: Synthetic peptide
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
RXQTWQCFXKENN

SEQ ID NO: 968 - protein, 13 aa, Artificial Sequence
  Description of Artificial Sequence: Synthetic peptide
  MOD_RES (1)..(1): D-Arg
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
RXQTWQCFXKENN

SEQ ID NO: 969 - protein, 13 aa, Artificial Sequence
  Description of Artificial Sequence: Synthetic peptide
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
FXQTWQCFXKENN

SEQ ID NO: 970 - protein, 13 aa, Artificial Sequence
  Description of Artificial Sequence: Synthetic peptide
  MOD_RES (1)..(1): D-Phe
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
FXQTWQCFXKENN

SEQ ID NO: 971 - protein, 13 aa, Artificial Sequence
  Description of Artificial Sequence: Synthetic peptide
  MOD_RES (1)..(1): 2-Nal
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
XXQTWQCFXKENN

SEQ ID NO: 972 - protein, 13 aa, Artificial Sequence
  Description of Artificial Sequence: Synthetic peptide
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
TXQTWQCFXKENN

SEQ ID NO: 973 - protein, 13 aa, Artificial Sequence
  Description of Artificial Sequence: Synthetic peptide
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
LXQTWQCFXKENN

SEQ ID NO: 974 - protein, 13 aa, Artificial Sequence
  Description of Artificial Sequence: Synthetic peptide
  MOD_RES (1)..(1): D-Gln
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
QXQTWQCFXKENN

SEQ ID NO: 975 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Acpc
XQTWQCFXXENN

SEQ ID NO: 976 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Acbc
XQTWQCFXXENN

SEQ ID NO: 977 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Achc
XQTWQCFXXENN

SEQ ID NO: 978 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Acvc
XQTWQCFXXENN

SEQ ID NO: 979 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): 4-amino-4-carboxy-piperidine
XQTWQCFXXENN

SEQ ID NO: 980 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): 4-amino-4-carboxy-tetrahydropyran
XQTWQCFXXENN

SEQ ID NO: 981 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (10)..(10): Lys(Ac)
XQTWQCFXLKNG

SEQ ID NO: 982 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLENG

SEQ ID NO: 983 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLQNG

SEQ ID NO: 984 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
  MOD_RES (12)..(12): Beta-Ala
XQTWQCFXLQNA

SEQ ID NO: 985 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLQDG

SEQ ID NO: 986 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLeu
XQTWQCFXLQDG

SEQ ID NO: 987 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
  MOD_RES (12)..(12): Beta-Ala
XQTWQCFXXQNA

SEQ ID NO: 988 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 1,2,3,4-tetrahydro-norharman
  MOD_RES (9)..(9): Aib
XQTWQCFXXQNG

SEQ ID NO: 989 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 5-hydroxyTrp
  MOD_RES (9)..(9): Aib
XQTWQCFWXQNG

SEQ ID NO: 990 - protein, 13 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (11)..(11): Asn(isobutyl)
XQTWQCFXKKNGN

SEQ ID NO: 991 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
  MOD_RES (11)..(11): Asp(1,4-diaminoethane)
XQTWQCFXKKDG

SEQ ID NO: 992 - protein, 13 aa, Artificial Sequence
  Description of Artificial Sequence: Synthetic peptide
  MOD_RES (1)..(1): D-Phe
  MOD_RES (2)..(2): Abu
  MOD_RES (8)..(8): Phe[4-(2-aminoethoxy)]
  MOD_RES (9)..(9): 2-Nal
  MOD_RES (10)..(10): 4-amino-4-carboxy-tetrahydropyran
FXQTWQCFXXENN

SEQ ID NO: 993 - protein, 13 aa, Artificial Sequence
  Description of Artificial Sequence: Synthetic peptide
  MOD_RES (1)..(1): D-Arg
  MOD_RES (2)..(2): Abu
  MOD_RES (8)..(8): Phe[4-(2-aminoethoxy)]
  MOD_RES (9)..(9): 2-Nal
  MOD_RES (10)..(10): 4-amino-4-carboxy-tetrahydropyran
RXQTWQCFXXENN

SEQ ID NO: 994 - protein, 13 aa, Artificial Sequence
  Description of Artificial Sequence: Synthetic peptide
  MOD_RES (1)..(1): D-Lys
  MOD_RES (2)..(2): Abu
  MOD_RES (8)..(8): Phe(4-OMe)
  MOD_RES (9)..(9): 2-Nal
  MOD_RES (10)..(10): alpha-MeLeu
KXQTWQCFXLENG

SEQ ID NO: 995 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Aib
XQTWQCFXXQNG

SEQ ID NO: 996 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 997 - protein, 13 aa, Artificial Sequence
  Description of Artificial Sequence: Synthetic peptide
  MOD_RES (1)..(1): D-Lys
  MOD_RES (2)..(2): Abu
  MOD_RES (8)..(8): Phe(4-OMe)
  MOD_RES (9)..(9): 2-Nal
  MOD_RES (10)..(10): alpha-MeLys
KXQTWQCFXKENG

SEQ ID NO: 998 - protein, 12 aa, Artificial Sequence
  Description of Artificial Sequence: Synthetic peptide
  MOD_RES (1)..(1): Abu
  MOD_RES (7)..(7): Phe(4-OBzl)
  MOD_RES (9)..(9): alpha-MeLys
XQTWQCFWKENG

SEQ ID NO: 999 - protein, 12 aa, Artificial Sequence
  Description of Artificial Sequence: Synthetic peptide
  MOD_RES (1)..(1): Abu
  MOD_RES (7)..(7): Tyr(Bzl)
  MOD_RES (9)..(9): alpha-MeLys
XQTWQCYWKENG

SEQ ID NO: 1000 - protein, 12 aa, Artificial Sequence
  Description of Artificial Sequence: Synthetic peptide
  MOD_RES (1)..(1): allylGly
  MOD_RES (6)..(6): allylGly
GADWVGYWHTFG

SEQ ID NO: 1001 - protein, 12 aa, Artificial Sequence
  Description of Artificial Sequence: Synthetic peptide
  MOD_RES (1)..(1): allylGly
  MOD_RES (6)..(6): allylGly
GADWVGYWHTFG

SEQ ID NO: 1002 - protein, 14 aa, Artificial Sequence
  Description of Artificial Sequence: Synthetic peptide
  MOD_RES (1)..(1): 2-(3'-butenyl)Gly
  MOD_RES (6)..(6): 2-(4'-pentenyl)Gly
  MOD_RES (13)..(13): (2-aminoethoxy)acetic acid
  MOD_RES (14)..(14): D-Lys
GRTWQGYWRKFGXK

SEQ ID NO: 1003 - protein, 14 aa, Artificial Sequence
  Description of Artificial Sequence: Synthetic peptide
  MOD_RES (1)..(1): 2-(4'-pentenyl)Gly
  MOD_RES (6)..(6): 2-(3'-butenyl)Gly
  MOD_RES (13)..(13): (2-aminoethoxy)acetic acid
  MOD_RES (14)..(14): D-Lys
GRTWQGYWRKFGXK

SEQ ID NO: 1004 - protein, 14 aa, Artificial Sequence
  Description of Artificial Sequence: Synthetic peptide
  MOD_RES (1)..(1): allylGly
  MOD_RES (6)..(6): 2-(4'-pentenyl)Gly
  MOD_RES (13)..(13): (2-aminoethoxy)acetic acid
  MOD_RES (14)..(14): D-Lys
GRTWQGYWRKFGXK

SEQ ID NO: 1005 - protein, 14 aa, Artificial Sequence
  Description of Artificial Sequence: Synthetic peptide
  MOD_RES (1)..(1): 2-(4'-pentenyl)Gly
  MOD_RES (6)..(6): allylGly
  MOD_RES (13)..(13): (2-aminoethoxy)acetic acid
  MOD_RES (14)..(14): D-Lys
GRTWQGYWRKFGXK

SEQ ID NO: 1006 - protein, 14 aa, Artificial Sequence
  Description of Artificial Sequence: Synthetic peptide
  MOD_RES (1)..(1): 2-(3'-butenyl)Gly
  MOD_RES (6)..(6): 2-(3'-butenyl)Gly
  MOD_RES (13)..(13): (2-aminoethoxy)acetic acid
  MOD_RES (14)..(14): D-Lys
GRTWQGYWRKFGXK

SEQ ID NO: 1007 - protein, 14 aa, Artificial Sequence
  Description of Artificial Sequence: Synthetic peptide
  MOD_RES (1)..(1): 2-(3'-butenyl)Gly
  MOD_RES (6)..(6): allylGly
  MOD_RES (13)..(13): (2-aminoethoxy)acetic acid
  MOD_RES (14)..(14): D-Lys
GRTWQGYWRKFGXK

SEQ ID NO: 1008 - protein, 14 aa, Artificial Sequence
  Description of Artificial Sequence: Synthetic peptide
  MOD_RES (1)..(1): allylGly
  MOD_RES (6)..(6): 2-(3'-butenyl)Gly
  MOD_RES (13)..(13): (2-aminoethoxy)acetic acid
  MOD_RES (14)..(14): D-Lys
GRTWQGYWRKFGXK

SEQ ID NO: 1009 - protein, 14 aa, Artificial Sequence
  Description of Artificial Sequence: Synthetic peptide
  MOD_RES (1)..(1): Dap
  MOD_RES (13)..(13): (2-aminoethoxy)acetic acid
  MOD_RES (14)..(14): D-Lys
XQTWQEYWRENGXK

SEQ ID NO: 1010 - protein, 14 aa, Artificial Sequence
  Description of Artificial Sequence: Synthetic peptide
  MOD_RES (6)..(6): Dab
  MOD_RES (13)..(13): (2-aminoethoxy)acetic acid
  MOD_RES (14)..(14): D-Lys
EQTWQXYWRENGXK

SEQ ID NO: 1011 - protein, 14 aa, Artificial Sequence
  Description of Artificial Sequence: Synthetic peptide
  MOD_RES (6)..(6): Dap
  MOD_RES (13)..(13): (2-aminoethoxy)acetic acid
  MOD_RES (14)..(14): D-Lys
EQTWQXYWRENGXK

SEQ ID NO: 1012 - protein, 14 aa, Artificial Sequence
  Description of Artificial Sequence: Synthetic peptide
  MOD_RES (1)..(1): Dab
  MOD_RES (13)..(13): (2-aminoethoxy)acetic acid
  MOD_RES (14)..(14): D-Lys
XQTWQEYWRENGXK

SEQ ID NO: 1013 - protein, 14 aa, Artificial Sequence
  Description of Artificial Sequence: Synthetic peptide
  MOD_RES (1)..(1): Dap
  MOD_RES (6)..(6): D-Asp
  MOD_RES (13)..(13): (2-aminoethoxy)acetic acid
  MOD_RES (14)..(14): D-Lys
XQTWQDYWRENGXK

SEQ ID NO: 1014 - protein, 14 aa, Artificial Sequence
  Description of Artificial Sequence: Synthetic peptide
  MOD_RES (1)..(1): Dap
  MOD_RES (13)..(13): (2-aminoethoxy)acetic acid
  MOD_RES (14)..(14): D-Lys
XQTWQDYWRENGXK

SEQ ID NO: 1015 - protein, 14 aa, Artificial Sequence
  Description of Artificial Sequence: Synthetic peptide
  MOD_RES (6)..(6): Dab
  MOD_RES (13)..(13): (2-aminoethoxy)acetic acid
  MOD_RES (14)..(14): D-Lys
DQTWQXYWRENGXK

SEQ ID NO: 1016 - protein, 14 aa, Artificial Sequence
  Description of Artificial Sequence: Synthetic peptide
  MOD_RES (1)..(1): Dab
  MOD_RES (13)..(13): (2-aminoethoxy)acetic acid
  MOD_RES (14)..(14): D-Lys
XQTWQDYWRENGXK

SEQ ID NO: 1017 - protein, 14 aa, Artificial Sequence
  Description of Artificial Sequence: Synthetic peptide
  MOD_RES (1)..(1): D-Dab
  MOD_RES (6)..(6): D-Asp
  MOD_RES (13)..(13): (2-aminoethoxy)acetic acid
  MOD_RES (14)..(14): D-Lys
XQTWQDYWRENGXK

SEQ ID NO: 1018 - protein, 14 aa, Artificial Sequence
  Description of Artificial Sequence: Synthetic peptide
  MOD_RES (1)..(1): D-Asp
  MOD_RES (6)..(6): D-Dab
  MOD_RES (13)..(13): (2-aminoethoxy)acetic acid
  MOD_RES (14)..(14): D-Lys
DQTWQXYWRENGXK

SEQ ID NO: 1019 - protein, 14 aa, Artificial Sequence
  Description of Artificial Sequence: Synthetic peptide
  MOD_RES (1)..(1): D-Asp
  MOD_RES (6)..(6): D-Dap
  MOD_RES (13)..(13): (2-aminoethoxy)acetic acid
  MOD_RES (14)..(14): D-Lys
DQTWQXYWRENGXK

SEQ ID NO: 1020 - protein, 12 aa, Artificial Sequence
  Description of Artificial Sequence: Synthetic peptide
  MOD_RES (1)..(1): Pen
XADWVCYWHTFG

SEQ ID NO: 1021 - protein, 12 aa, Artificial Sequence
  Description of Artificial Sequence: Synthetic peptide
  MOD_RES (6)..(6): Pen
CADWVXYWHTFG

SEQ ID NO: 1022 - protein, 14 aa, Artificial Sequence
  Description of Artificial Sequence: Synthetic peptide
  MOD_RES (1)..(1): D-Pen
  MOD_RES (13)..(13): (2-aminoethoxy)acetic acid
  MOD_RES (14)..(14): D-Lys
XADWVCYWHTFGXK

SEQ ID NO: 1023 - protein, 14 aa, Artificial Sequence
  Description of Artificial Sequence: Synthetic peptide
  MOD_RES (6)..(6): D-Pen
  MOD_RES (13)..(13): (2-aminoethoxy)acetic acid
  MOD_RES (14)..(14): D-Lys
CADWVXYWHTFGXK

SEQ ID NO: 1024 - protein, 14 aa, Artificial Sequence
  Description of Artificial Sequence: Synthetic peptide
  MOD_RES (1)..(1): Pen
  MOD_RES (13)..(13): (2-aminoethoxy)acetic acid
  MOD_RES (14)..(14): D-Lys
XRTWQCYWRKFGXK

SEQ ID NO: 1025 - protein, 14 aa, Artificial Sequence
  Description of Artificial Sequence: Synthetic peptide
  MOD_RES (6)..(6): Pen
  MOD_RES (13)..(13): (2-aminoethoxy)acetic acid
  MOD_RES (14)..(14): D-Lys
ACDWVXYWRKFGXK

SEQ ID NO: 1026 - protein, 14 aa, Artificial Sequence
  Description of Artificial Sequence: Synthetic peptide
  MOD_RES (2)..(2): Pen
  MOD_RES (13)..(13): (2-aminoethoxy)acetic acid
  MOD_RES (14)..(14): D-Lys
AXDWVCYWRKFGXK

SEQ ID NO: 1027 - protein, 14 aa, Artificial Sequence
  Description of Artificial Sequence: Synthetic peptide
  MOD_RES (2)..(2): hCys
  MOD_RES (6)..(6): Pen
  MOD_RES (13)..(13): (2-aminoethoxy)acetic acid
  MOD_RES (14)..(14): D-Lys
ACDWVXYWRKFGXK

SEQ ID NO: 1028 - protein, 12 aa, Artificial Sequence
  Description of Artificial Sequence: Synthetic peptide
  MOD_RES (6)..(6): Pen
  MOD_RES (9)..(9): alpha-MeLeu
CQTWQXYWLENG

SEQ ID NO: 1029 - protein, 12 aa, Artificial Sequence
  Description of Artificial Sequence: Synthetic peptide
  MOD_RES (6)..(6): Pen
  MOD_RES (9)..(9): D-Asn
CQTWQXYWNENG

SEQ ID NO: 1030 - protein, 12 aa, Artificial Sequence
  Description of Artificial Sequence: Synthetic peptide
  MOD_RES (1)..(1): Pen
  MOD_RES (6)..(6): Pen
  MOD_RES (9)..(9): N-Me-Arg
XQTWQXYWRENG

SEQ ID NO: 1031 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): [Phe(4-OMe)](OMe)
  MOD_RES (8)..(8): 2-Nal
  MOD_RES (9)..(9): alpha-MeOrn
  MOD_RES (10)..(10): Lys(Ac)
XQTWQXFXXKNG

SEQ ID NO: 1032 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (9)..(9): alpha-MeLys
  MOD_RES (10)..(10): Lys(Ac)
XQTWQXFWKKNG

SEQ ID NO: 1033 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): alpha-MeLys
  MOD_RES (10)..(10): Lys(Ac)
XQTWQXFXKKNG

SEQ ID NO: 1034 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe[4-(2-aminoethoxy)]
  MOD_RES (8)..(8): 2-Nal
  MOD_RES (9)..(9): alpha-MeLys
  MOD_RES (10)..(10): Lys(Ac)
XQTWQXFXKKNN

SEQ ID NO: 1035 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe[4-(2-aminoethoxy)]
  MOD_RES (9)..(9): 2-Nal
  MOD_RES (10)..(10): Aib
  MOD_RES (11)..(11): Lys(Ac)
FXNTWQXFXXKNN

SEQ ID NO: 1036 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-CONH2)
  MOD_RES (8)..(8): 2-Nal
  MOD_RES (9)..(9): Acvc
  MOD_RES (10)..(10): Lys(Ac)
XNTWQXFXXKNN

SEQ ID NO: 1037 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(4-OMe)
  MOD_RES (8)..(8): 2-Nal
  MOD_RES (9)..(9): Acvc
  MOD_RES (10)..(10): Lys(Ac)
XNTWQXFXXKNN

SEQ ID NO: 1038 - protein, 12 aa, Artificial Sequence
  Description of Artificial Sequence: Synthetic peptide
  MOD_RES (1)..(1): Abu
  MOD_RES (7)..(7): Phe(4-OMe)
  MOD_RES (8)..(8): 2-Nal
  MOD_RES (9)..(9): alpha-MeLys
XQTWQCFXKENG

SEQ ID NO: 1039 - protein, 13 aa, Artificial Sequence
  Description of Artificial Sequence: Synthetic peptide
  MOD_RES (1)..(1): D-Lys
  MOD_RES (2)..(2): Abu
  MOD_RES (8)..(8): Phe(4-OMe)
  MOD_RES (9)..(9): 2-Nal
  MOD_RES (10)..(10): alpha-MeLeu
KXQTWQCFXLENG

SEQ ID NO: 1040 - protein, 12 aa, Artificial Sequence
  Description of Artificial Sequence: Synthetic peptide
  MOD_RES (1)..(1): Abu
  MOD_RES (7)..(7): Tyr(Bzl)
  MOD_RES (9)..(9): alpha-MeLys
XQTWQCYWKENG

SEQ ID NO: 1041 - protein, 13 aa, Artificial Sequence
  Description of Artificial Sequence: Synthetic peptide
  MOD_RES (1)..(1): D-Arg
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
RXQTWQCFXKENN

SEQ ID NO: 1042 - protein, 13 aa, Artificial Sequence
  Description of Artificial Sequence: Synthetic peptide
  MOD_RES (1)..(1): D-Gln
  MOD_RES (2)..(2): Abu
  MOD_RES (8)..(8): Phe[4-(2-aminoethoxy)]
  MOD_RES (9)..(9): 2-Nal
  MOD_RES (10)..(10): alpha-MeLys
QXQTWQCFXKENN

SEQ ID NO: 1043 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Acpc
XQTWQCFXXENN

SEQ ID NO: 1044 - protein, 12 aa, Artificial Sequence
  Description of Artificial Sequence: Synthetic peptide
  MOD_RES (9)..(9): hLeu
CQTWQCYWLENG

SEQ ID NO: 1045 - protein, 16 aa, Artificial Sequence
  Description of Artificial Sequence: Synthetic peptide
  MOD_RES (15)..(15): Azt
  MOD_RES (16)..(16): D-Lys
CADWVWCYWHTFGAXK

SEQ ID NO: 1046 - protein, 14 aa, Artificial Sequence
  Description of Artificial Sequence: Synthetic peptide
  MOD_RES (1)..(1): Abu
  MOD_RES (13)..(13): (2-aminoethoxy)acetic acid
  MOD_RES (14)..(14): D-Lys
XRTWQCYWRKFGXK

SEQ ID NO: 1047 - protein, 12 aa, Artificial Sequence
  Description of Artificial Sequence: Synthetic peptide
  MOD_RES (1)..(1): Abu
  MOD_RES (7)..(7): Phe[4-(2-aminoethoxy)]
  MOD_RES (8)..(8): 2-Nal
  MOD_RES (9)..(9): Achc
XQTWQCFXXENN

SEQ ID NO: 1048 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): 4-amino-4-carboxy-tetrahydropyran
  MOD_RES (11)..(11): Cit
FXNTWQXFXXXNN

SEQ ID NO: 1049 - protein, 13 aa, Artificial Sequence
  Description of Artificial Sequence: Synthetic peptide
  MOD_RES (1)..(1): D-Phe
  MOD_RES (2)..(2): Pen
  MOD_RES (7)..(7): Pen
  MOD_RES (8)..(8): Phe(4-OMe)
  MOD_RES (9)..(9): 2-Nal
  MOD_RES (10)..(10): Achc
FXNTWQXFXXENN

SEQ ID NO: 1050 - protein, 12 aa, Artificial Sequence
  Description of Artificial Sequence: Synthetic peptide
  MOD_RES (1)..(1): Pen
  MOD_RES (6)..(6): Pen
  MOD_RES (7)..(7): Phe(CONH2)
  MOD_RES (8)..(8): 2-Nal
  MOD_RES (9)..(9): Aib
  MOD_RES (10)..(10): Lys(Ac)
XNTWQXFXXKNN

SEQ ID NO: 1051 - protein, 15 aa, Artificial Sequence
  Description of Artificial Sequence: Synthetic peptide
CRSWQCYWNKFGADD

SEQ ID NO: 1052 - protein, 15 aa, Artificial Sequence
  Description of Artificial Sequence: Synthetic peptide
CHTWQCYWLNFGDEE

SEQ ID NO: 1053 - protein, 15 aa, Artificial Sequence
  Description of Artificial Sequence: Synthetic peptide
CRTWQCYWLNFGNEQ

SEQ ID NO: 1054 - protein, 15 aa, Artificial Sequence
  Description of Artificial Sequence: Synthetic peptide
CRTWQCYWSEFGTGE

SEQ ID NO: 1055 - protein, 15 aa, Artificial Sequence
  Description of Artificial Sequence: Synthetic peptide
CRTWQCYWLRLGDEG

SEQ ID NO: 1056 - protein, 15 aa, Artificial Sequence
  Description of Artificial Sequence: Synthetic peptide
CHTWQCYWSTLGPEA

SEQ ID NO: 1057 - protein, 15 aa, Artificial Sequence
  Description of Artificial Sequence: Synthetic peptide
CSTWQCYWSKQSGGS

SEQ ID NO: 1058 - protein, 15 aa, Artificial Sequence
  Description of Artificial Sequence: Synthetic peptide
CHTWQCYWLNNGTSQ

SEQ ID NO: 1059 - protein, 15 aa, Artificial Sequence
  Description of Artificial Sequence: Synthetic peptide
CHTWQCYWRANDGRD

SEQ ID NO: 1060 - protein, 14 aa, Artificial Sequence
  Description of Artificial Sequence: Synthetic peptide
SGCRTWQCYWHEFG

SEQ ID NO: 1061 - protein, 14 aa, Artificial Sequence
  Description of Artificial Sequence: Synthetic peptide
NKCRTWQCYWHEYG

SEQ ID NO: 1062 - protein, 14 aa, Artificial Sequence
  Description of Artificial Sequence: Synthetic peptide
SGCRTWECYWHEYG

SEQ ID NO: 1063 - protein, 14 aa, Artificial Sequence
  Description of Artificial Sequence: Synthetic peptide
DACRTWECYWHKFG

SEQ ID NO: 1064 - protein, 14 aa, Artificial Sequence
  Description of Artificial Sequence: Synthetic peptide
PECRTWECYWHKFG

SEQ ID NO: 1065 - protein, 14 aa, Artificial Sequence
  Description of Artificial Sequence: Synthetic peptide
QVCQTWECYWREFG

SEQ ID NO: 1066 - protein, 14 aa, Artificial Sequence
  Description of Artificial Sequence: Synthetic peptide
DRCVTWECYWREFG

SEQ ID NO: 1067 - protein, 15 aa, Artificial Sequence
  Description of Artificial Sequence: Synthetic peptide
ADQCRTWQCYWHEFG

SEQ ID NO: 1068 - protein, 15 aa, Artificial Sequence
  Description of Artificial Sequence: Synthetic peptide
KENCRTWECYWREFG

SEQ ID NO: 1069 - protein, 15 aa, Artificial Sequence
  Description of Artificial Sequence: Synthetic peptide
VQECSTWQCYWRTFG

SEQ ID NO: 1070 - protein, 15 aa, Artificial Sequence
  Description of Artificial Sequence: Synthetic peptide
GEECSTWQCYWRKFG

SEQ ID NO: 1071 - protein, 15 aa, Artificial Sequence
  Description of Artificial Sequence: Synthetic peptide
DGSCRTWQCYWHQFG

SEQ ID NO: 1072 - protein, 15 aa, Artificial Sequence
  Description of Artificial Sequence: Synthetic peptide
NADCHSWECYWREFG

SEQ ID NO: 1073 - protein, 15 aa, Artificial Sequence
  Description of Artificial Sequence: Synthetic peptide
ERNCSTWECYWRAFG

SEQ ID NO: 1074 - protein, 15 aa, Artificial Sequence
  Description of Artificial Sequence: Synthetic peptide
RVGCSTWECYWREFG

SEQ ID NO: 1075 - protein, 15 aa, Artificial Sequence
  Description of Artificial Sequence: Synthetic peptide
KANCRTWQCYWRKFE

SEQ ID NO: 1076 - protein, 15 aa, Artificial Sequence
  Description of Artificial Sequence: Synthetic peptide
YEDCRTWQCYWENFG

SEQ ID NO: 1077 - protein, 14 aa, Artificial Sequence
  Description of Artificial Sequence: Synthetic peptide
CQTWQCYWRNFGDS

SEQ ID NO: 1078 - protein, 14 aa, Artificial Sequence
  Description of Artificial Sequence: Synthetic peptide
CQTWQCYWRNFESG

SEQ ID NO: 1079 - protein, 14 aa, Artificial Sequence
  Description of Artificial Sequence: Synthetic peptide
CQDWQCYWREFGPG

SEQ ID NO: 1080 - protein, 14 aa, Artificial Sequence
  Description of Artificial Sequence: Synthetic peptide
CQDWQCYWRSFGPQ

SEQ ID NO: 1081 - protein, 14 aa, Artificial Sequence
  Description of Artificial Sequence: Synthetic peptide
CQTWQCYWRTLGPS

SEQ ID NO: 1082 - protein, 12 aa, Artificial Sequence
  Description of Artificial Sequence: Synthetic peptide
CRTWQCYWQNFG

SEQ ID NO: 1083 - protein, 14 aa, Artificial Sequence
  Description of Artificial Sequence: Synthetic peptide
CGTWQCYWRTFGPS

SEQ ID NO: 1084 - protein, 14 aa, Artificial Sequence
  Description of Artificial Sequence: Synthetic peptide
CSTWQCYWHKFGNE

SEQ ID NO: 1085 - protein, 14 aa, Artificial Sequence
  Description of Artificial Sequence: Synthetic peptide
CRTWECYWRTYGPS

SEQ ID NO: 1086 - protein, 14 aa, Artificial Sequence
  Description of Artificial Sequence: Synthetic peptide
CRTWQCYWWENSQM

SEQ ID NO: 1087 - protein, 14 aa, Artificial Sequence
  Description of Artificial Sequence: Synthetic peptide
CQTWQCYWREFGGG

SEQ ID NO: 1088 - protein, 14 aa, Artificial Sequence
  Description of Artificial Sequence: Synthetic peptide
CQTWQCYWRTHGDR

SEQ ID NO: 1089 - protein, 12 aa, Artificial Sequence
  Description of Artificial Sequence: Synthetic peptide
CRDWQCYWLSRP

SEQ ID NO: 1090 - protein, 12 aa, Artificial Sequence
  Description of Artificial Sequence: Synthetic peptide
  MOD_RES (9)..(9): Lys(Palm)
CQTWQCYWKENG

SEQ ID NO: 1091 - protein, 12 aa, Artificial Sequence
  Description of Artificial Sequence: Synthetic peptide
  MOD_RES (9)..(9): Lys(PEG8)
CQTWQCYWKENG

SEQ ID NO: 1092 - protein, 12 aa, Artificial Sequence
  Description of Artificial Sequence: Synthetic peptide
  MOD_RES (9)..(9): hLeu
CQTWQCYWLEQG

SEQ ID NO: 1093 - protein, 12 aa, Artificial Sequence
  Description of Artificial Sequence: Synthetic peptide
  MOD_RES (7)..(7): D-Tyr
  MOD_RES (9)..(9): hLeu
CQTWQCYWLENG

SEQ ID NO: 1094 - protein, 12 aa, Artificial Sequence
  Description of Artificial Sequence: Synthetic peptide
  MOD_RES (7)..(7): N-MeTyr
  MOD_RES (9)..(9): hLeu
CQTWQCYWLENG

SEQ ID NO: 1095 - protein, 12 aa, Artificial Sequence
  Description of Artificial Sequence: Synthetic peptide
  MOD_RES (7)..(7): Tic-OH
  MOD_RES (9)..(9): hLeu
CQTWQCXWLENG

SEQ ID NO: 1096 - protein, 12 aa, Artificial Sequence
  Description of Artificial Sequence: Synthetic peptide
  MOD_RES (9)..(9): hLeu
CQTWQCEWLENG

SEQ ID NO: 1097 - protein, 12 aa, Artificial Sequence
  Description of Artificial Sequence: Synthetic peptide
  MOD_RES (9)..(9): hLeu
CQTWQCTWLENG

SEQ ID NO: 1098 - protein, 12 aa, Artificial Sequence
  Description of Artificial Sequence: Synthetic peptide
  MOD_RES (7)..(7): Cha
  MOD_RES (9)..(9): hLeu
CQTWQCXWLENG

SEQ ID NO: 1099 - protein, 12 aa, Artificial Sequence
  Description of Artificial Sequence: Synthetic peptide
  MOD_RES (9)..(9): alpha-MeLeu
CQTWQCYWLENG

SEQ ID NO: 1100 - protein, 12 aa, Artificial Sequence
  Description of Artificial Sequence: Synthetic peptide
  MOD_RES (9)..(9): D-Leu
CQTWQCYWLENG

SEQ ID NO: 1101 - protein, 13 aa, Artificial Sequence
  Description of Artificial Sequence: Synthetic peptide
  MOD_RES (9)..(9): hLeu
  MOD_RES (13)..(13): D-Lys
CQTWQCYWLENGK

SEQ ID NO: 1102 - protein, 12 aa, Artificial Sequence
  Description of Artificial Sequence: Synthetic peptide
  MOD_RES (9)..(9): hLeu
CQTWQCYWLENG

SEQ ID NO: 1103 - protein, 12 aa, Artificial Sequence
  Description of Artificial Sequence: Synthetic peptide
  MOD_RES (9)..(9): hLeu
CQTWQCYWLENE

SEQ ID NO: 1104 - protein, 12 aa, Artificial Sequence
  Description of Artificial Sequence: Synthetic peptide
  MOD_RES (9)..(9): hLeu
CQTWQCYWLENR

SEQ ID NO: 1105 - protein, 12 aa, Artificial Sequence
  Description of Artificial Sequence: Synthetic peptide
  MOD_RES (9)..(9): hLeu
CQTWQCYWLENF

SEQ ID NO: 1106 - protein, 12 aa, Artificial Sequence
  Description of Artificial Sequence: Synthetic peptide
  MOD_RES (9)..(9): hLeu
CQTWQCYWLENP

SEQ ID NO: 1107 - protein, 12 aa, Artificial Sequence
  Description of Artificial Sequence: Synthetic peptide
  MOD_RES (9)..(9): hLeu
CQTWQCYWLENQ

SEQ ID NO: 1108 - protein, 12 aa, Artificial Sequence
  Description of Artificial Sequence: Synthetic peptide
  MOD_RES (9)..(9): hLeu
CQTWQCYWLENL

SEQ ID NO: 1109 - protein, 12 aa, Artificial Sequence
  Description of Artificial Sequence: Synthetic peptide
  MOD_RES (9)..(9): hLeu
CQTWQCYWLEEG

SEQ ID NO: 1110 - protein, 12 aa, Artificial Sequence
  Description of Artificial Sequence: Synthetic peptide
  MOD_RES (9)..(9): hLeu
CQTWQCYWLERG

SEQ ID NO: 1111 - protein, 20 aa, Artificial Sequence
  Description of Artificial Sequence: Synthetic peptide
  MOD_RES (1)..(3): Any amino acid or absent
  MOD_RES (4)..(4): 2-allylglycine, 2-(3'-butenyl)glycine, 2-(4'-pentenyl)glycine, or 2-(5'-hexenyl)glycine
  MOD_RES (5)..(5): Ala, Arg, Sarc, alpha-MeOrn, alpha-MeSer, Cit, Dap, Dab, Dap(Ac), Gly, Lys, Asn, N-MeGln, N-MeArg, Orn or Gln
  MOD_RES (6)..(6): Asp, Thr or Asn
  MOD_RES (8)..(8): Val, Gln or Glu
  MOD_RES (9)..(9): 2-allylglycine, 2-(3'-butenyl)glycine, 2-(4'-pentenyl)glycine or 2-(5'-hexenyl)glycine
  MOD_RES (11)..(11): Trp, 1-Nal, 2-Nal, Phe(3,4-OMe2) 5-Hydroxy-Trp, Phe(3,4-Cl2) or Tyr(3-t-Bu)
  MOD_RES (13)..(13): Thr, Sarc, Glu, Phe, Arg, Leu, Lys, Beta-hAla, Val, Aib, Lys(Ac), Cit, Asp, Dab, Dap, Glu, hArg, Lys, Asn, Orn or Gln
  MOD_RES (15)..(15): Gly, Ser, Thr, Gln, Ala, Sarc, Beta-Ala, Glu, Arg or Asn
  MOD_RES (16)..(20): Any amino acid or absent
XXXGXXWXGYXHXFXXXXXX

SEQ ID NO: 1112 - protein, 20 aa, Artificial Sequence
  Description of Artificial Sequence: Synthetic peptide
  MOD_RES (1)..(3): Any amino acid or absent
  MOD_RES (5)..(5): Ala, Arg, Glu, Phe, Leu, Thr, Ser, Aib, Sarc, alpha-MeOrn, alpha-MeSer, Cit, Dap, Dab, Dap(Ac), Gly, Lys, Asn, N-MeGln, N-MeArg, Orn or Gln
  MOD_RES (6)..(6): Asp, Thr, Asn or Phe
  MOD_RES (8)..(8): Val, Gln, Glu or Lys
  MOD_RES (11)..(11): Trp, 1-Nal, 2-Nal, Phe(3,4-OMe2), 5-Hydroxy-Trp, Phe(3,4-Cl2) or Tyr(3-t-Bu)
  MOD_RES (13)..(13): Thr, Sarc, Glu, Phe, Arg, Leu, Lys, Beta-hAla, Val, Aib, Lys(Ac), Cit, Asp, Dab, Dap, Glu, hArg, Lys, Asn, Orn, Gln or absent
  MOD_RES (14)..(14): Phe, Tyr, Asn, Arg, Gln, Lys(Ac), His, Dap(Ac), Dab(Ac), Asp or absent
  MOD_RES (15)..(15): Gly, Ser, Thr, Gln, Ala, Sarc, beta-Ala, Glu, Arg, Asn or absent
  MOD_RES (16)..(20): Any amino acid or absent
XXXCXXWXCYXHXXXXXXXX

SEQ ID NO: 1113 - protein, 20 aa, Artificial Sequence
  Description of Artificial Sequence: Synthetic peptide
  MOD_RES (1)..(3): Any amino acid or absent
  MOD_RES (5)..(5): Ala, Arg, Sarc, alpha-MeOrn, alpha-MeSer, Cit, Dap, Dab, Dap(Ac), Gly, Lys, Asn, N-MeGln, N-MeArg, Orn or Gln
  MOD_RES (6)..(6): Asp, Thr or Asn
  MOD_RES (8)..(8): Val, Gln or Glu
  MOD_RES (11)..(11): Trp, 1-Nal, 2-Nal, Phe(3,4-OMe2), 5-Hydroxy-Trp, Phe(3,4-Cl2) or Tyr(3-t-Bu)
  MOD_RES (13)..(13): Thr, Sarc, Glu, Phe, Arg, Leu, Lys, beta-hAla, Val, Aib, Lys(Ac), Cit, Asp, Dab, Dap, Glu, hArg, Lys, Asn, Orn, Gln or absent
  MOD_RES (15)..(15): Gly, Ser, Thr, Gln, Ala, Sarc, beta-Ala, Glu, Arg, Asn or absent
  MOD_RES (16)..(20): Any amino acid or absent
XXXCXXWXCYXHXFXXXXXX

SEQ ID NO: 1114 - protein, 19 aa, Artificial Sequence
  Description of Artificial Sequence: Synthetic peptide
  MOD_RES (1)..(3): Any amino acid or absent
  MOD_RES (5)..(6): Any amino acid
  MOD_RES (8)..(8): Any amino acid
  MOD_RES (10)..(10): Tyr, 1-Nal, 2-Nal, Phe(3,4-F2), Phe(3,4-Cl2), Phe(3-Me), Phe[4-(2-aminoethoxy)], Phe[4-(2-(acetyl-aminoethoxy)], Phe(4-Br), Phe(4-CONH2), Phe(4-Cl), Phe(4-CN), Phe(4-guanidino) Phe(4-Me), Phe(4-NH2), Phe(4-N3),
  MOD_RES (10)..(10): continued from above; Phe(4-OMe) or Phe(4-OBzl)
  MOD_RES (11)..(11): Trp, 1-Nal, Phe(3,4-OMe2), 5-Hydroxy-Trp, Phe(3,4-Cl2) or Tyr(3-t-Bu)
  MOD_RES (12)..(12): Arg, Lys, His, hArg, Cit, Orn, 1-Nal, D-Ala, D-Leu, D-Phe, D-Asn, D-Asp, Agp, Leu, Beta-hLeu, Aib, Beta-hAla, Beta-hVal, Beta-hArg, hLeu, Dap, 4-amino-4-carboxy-tetrahydropyran, Achc, Acpc, Acbc, Acvc, Agp, Aib, alpha-DiethylGly, alpha-MeLys,
  MOD_RES (12)..(12): continued from above; alpha-MeLys(Ac), alpha-Me-Leu, alpha-MeOrn, alpha-MeSer, alpha-MeVal, Cha, Cit, Cpa, D-Asn, Glu, hArg or Lys
  MOD_RES (13)..(13): Cha, Ogl, Aib, Leu, Val, Dab, Glu, Lys, Beta-hLeu, Beta-hAla, Beta-hVal, Beta-Glu, Lys(Ac), Cit, Asp, Dab, Dap, Glu, hArg, Lys, Asn, Orn, Lys(Ac) or Gln
  MOD_RES (14)..(14): Phe, Tic, Asn, Tyr, Asn, Arg, Gln, Lys(Ac), His, Dap(Ac), Dab(Ac) or Asp
  MOD_RES (16)..(16): Any amino acid
  MOD_RES (17)..(17): D-Lys
  MOD_RES (18)..(19): Any amino acid or absent
XXXCXXWXCXXXXXGXKXX

What is claimed is:

1. A peptide inhibitor of an interleukin-23 receptor, or a pharmaceutically acceptable salt or solvate thereof, wherein the peptide inhibitor comprises the amino acid sequence of Formula Ir:

X1-X2-X3-X4-X5-X6-X7-X8-X9-X10-X11-X12-
X13-X14-X15-X16-X17-X18-X19-X20     (Ir)

wherein
X1 is any amino acid or absent;
X2 is any amino acid or absent;
X3 is any amino acid or absent;
X4 is Cys, Pen, hCys, D-Pen, D-Cys, D-hCys, Met, Glu, Asp, Lys, Orn, Dap, Dab, D-Dap, D-Dab, D-Asp, D-Glu, D-Lys, Sec, 2-chloromethylbenzoic acid, mercapto-propanoic acid, mercapto-butyric acid, 2-chloro-acetic acid, 3-choro-propanoic acid, 4-chloro-butyric acid, 3-chloro-isobutyric acid, Abu, β-azido-Ala-OH, propargylglycine, 2-(3'-butenyl)glycine, 2-allylglycine, 2-(3'-butenyl)glycine, 2-(4'-pentenyl)glycine, 2-(5'-hexenyl)glycine, or absent;
X5 is any amino acid;
X6 is any amino acid;
X7 is Trp, Glu, Gly, Ile, Asn, Pro, Arg, Thr or OctGly, or a corresponding α-methyl amino acid form of any of the foregoing;
X8 is any amino acid;
X9 is Cys, Pen, hCys, D-Pen, D-Cys, D-hCys, Glu, Lys, Orn, Dap, Dab, D-Dap, D-Dab, D-Asp, D-Glu, D-Lys, Asp, Leu, Val, Phe, Ser, Sec, Abu, β-azido-Ala-OH, propargylglycine, 2-2-allylglycine, 2-(3'-butenyl)glycine, 2-(4'-pentenyl)glycine, Ala, hCys, Met, MeCys, (D)Tyr or 2-(5'-hexenyl)glycine;
X10 is Tyr, Phe(4-OMe), 1-Nal, 2-Nal, Aic, α-MePhe, Bip, (D)Cys, Cha, DMT, (D)Tyr, Glu, His, hPhe(3,4-dimethoxy), hTyr, N-Me-Tyr, Trp, Phe(4-CONH$_2$), Phe (4-phenoxy), Thr, Tic, Tyr(3-tBu), Phe(4-tBu), Phe(4-CN), Phe(4-Br), Phe(4-NH$_2$), Phe(4-F), Phe(3,5-F$_2$), Phe(4-CH$_2$CO$_2$H), Phe(penta-F), Phe(3,4-Cl$_2$), Phe(4-CF$_3$), Bip, Cha, 4-PyridylAlanine, βhTyr, OctGly, Phe (4-N$_3$), Phe(4-Br), Phe[4-(2-aminoethoxy)], Phe, a Phe analog, or a Tyr analog, or a corresponding α-methyl amino acid form of any of the foregoing;
X11 is 2-Nal, 1-Nal, 2,4-dimethylPhe, Bip, Phe(3,4-Cl$_2$), Phe (3,4-F$_2$), Phe(4-CO$_2$H), βhPhe(4-F), α-Me-Trp, 4-phenylcyclohexyl, Phe(4-CF$_3$), Phe(3,4-OMe$_2$), α-MePhe, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino, Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydro-norharman, Phe(4-CONH$_2$), Phe(3,4-Dimethoxy), Phe(2,3-Cl$_2$), Phe(2,3-F$_2$), Phe(4-F), 4-phenylcyclohexylalanine or Bip, or a corresponding α-methyl amino acid form of any of the foregoing;
X12 is His, Phe, Arg, N-Me-His, Val, Cav, Cpa, Leu, Cit, hLeu, 3-Pal, t-butyl-Ala, α-MeLys, D-Ala, (D)Asn, (D)Asp, (D)Leu, (D)Phe, (D)Tyr, Aib, α-MeLeu, α-MeOrn, β-Aib, β-Ala, βhAla, βhArg, βhLeu, βhVal, β-spiro-pip, Glu, hArg, Ile, Lys, N-MeLeu, N-MeArg, Ogl, Orn, Pro, Gln, Ser, Thr, Tle, t-butyl-Gly, 4-amino-4-carboxy-tetrahydropyran (THP), Achc Acpc, Acbc, Acvc, Agp, Aib, α-DiethylGly, α-MeLys(Ac), α-Me-Orn, α-MeSer, α-MeVal, Cha, Cit, Cpa, (D)Asn, Glu, hArg, or Lys, or a corresponding α-methyl amino acid form of any of the foregoing;
X13 is Thr, Sarc, Glu, Phe, Arg, Leu, Asn, Cit, Lys, Arg, Orn, Val, βhAla, Lys(Ac), (D)Asn, (D)Leu, (D)Phe, (D)Thr, Ala, α-MeLeu, Aib, β-Ala, β-Glu, βhLeu, βhVal, β-spiro-pip, Cha, Chg, Asp, Dab, Dap, α-DiethylGly, hLeu, Asn, Ogl, Pro, Gln, Ser, β-spiro-pip, Thr, Tba, Tle or Aib, or a corresponding α-methyl amino acid form of any of the foregoing;
X14 is Phe, Tyr, Glu, Gly, His, Lys, Leu, Met, Asn, Lys(Ac), Dap(Ac), Asp, Pro, Gln, Arg, Ser, Thr, Tic or βhPhe, or a corresponding α-methyl amino acid form of any of the foregoing;
X15 is Gly, Ser, Thr, Gln, Ala, (D)Ala, (D)Asn, (D)Asp, (D)Leu, (D)Phe, (D)Thr, Aea, Asp, Asn, Glu, Phe, Gly, Lys, Leu, Pro, Arg, β-Ala, or Sarc, or a corresponding α-methyl amino acid form of any of the foregoing;

X16 is any amino acid or absent;
X17 is any amino acid or absent;
X18 is any amino acid or absent;
X19 is any amino acid or absent; and
X20 is any amino acid or absent,
wherein the peptide inhibitor is cyclized via a bond between X4 and X9, and
wherein the peptide inhibitor inhibits the binding of an interleukin-23 (IL-23) to an IL-23 receptor.

2. The peptide inhibitor of claim 1, wherein the bond between X4 and X9 is a disulfide bond, a thioether bond, a lactam bond, a triazole ring, a selenoether bond, a diselenide bond, or an olefin bond.

3. The peptide inhibitor of claim 1, wherein X4 is Pen and X9 is Pen, and the bond is a disulfide bond.

4. The peptide inhibitor of claim 3, wherein
X7 is Trp;
X10 is Phe, Tyr, a Phe analog, or a Tyr analog;
X11 is Trp, 1-Nal or 2-Nal; and
X12 is Aib, α-Me-Lys, α-Me-Val, α-Me-Leu; Achc, Acvc, Acpc, or 4-amino-4-carboxy-tetrahydropyran (THP).

5. The peptide inhibitor of claim 4, wherein the peptide inhibitor comprises any of the following amino acid sequences:

(SEQ ID NO: 282)
Ac-[Pen]-Q-T-W-Q-[Pen]-[Phe(4-OMe)]-[2-Nal]-[α-Me-Lys]-ENG-NH₂;

(SEQ ID NO: 283)
Ac-[Pen]-N-T-W-Q-[Pen]-[Phe[4-(2-aminoethoxy)]]-[2-Nal]-[Aib]-[Lys(Ac)]-NN-NH₂;

(SEQ ID NO: 285)
Ac-[Pen]-Q-T-W-Q-[Pen]-[Phe[4-(2-aminoethoxy)]]-[2-Nal]-[α-MeLeu]-[Lys(Ac)]-NN-NH₂;

(SEQ ID NO: 668)
Ac-[Pen]-QTWQ-[Pen]-[Phe(4-CONH₂)]-[2-Nal]-[α-MeLys]-[Lys(Ac)]-NN-NH₂;

(SEQ ID NO: 603)
Ac-[Pen]-Q-T-W-Q-[Pen]-[Phe[4-(2-aminoethoxy)]]-[2-Nal]-[α-MeLeu]-QNN-NH₂;

(SEQ ID NO: 286)
Ac-[Pen]-Q-T-W-Q-[Pen]-[Phe(4-CONH₂)]-[2-Nal]-[α-MeLys]-[Lys(Ac)]-NN-NH₂;

(SEQ ID NO: 598)
Ac-[Pen]-QTWQ-[Pen]-[Phe[4-(2-aminoethoxy)]]-[2-Nal]-[α-MeLys]-[Lys(Ac)]-NG-NH₂;

(SEQ ID NO: 1034)
Ac-[Pen]-QTWQ-[Pen]-[Phe[4-(2-aminoethoxy)]]-[2-Nal]-[α-MeLys]-[Lys(Ac)]-NN-NH₂;

(SEQ ID NO: 601)
Ac-[Pen]-QTWQ-[Pen]-[Phe[4-(2-aminoethoxy)]]-[2-Nal]-[α-MeLys]-ENA-NH₂;

(SEQ ID NO: 602)
Ac-[Pen]-QTWQ-[Pen]-[Phe[4-(2-aminoethoxy)]]-[2-Nal]-[α-MeLeu]-[Lys(Ac)]-NN-NH₂;

(SEQ ID NO: 603)
Ac-[Pen]-QTWQ-[Pen]-[Phe[4-(2-aminoethoxy)]]-[2-Nal]-[α-MeLeu]-QNN-NH₂;

(SEQ ID NO: 604)
Ac-[Pen]-QTWQ-[Pen]-[Phe[4-(2-aminoethoxy)]]-[2-Nal]-[Aib]-ENN-NH₂;

(SEQ ID NO: 605)
Ac-[Pen]-QTWQ-[Pen]-[Phe[4-(2-aminoethoxy)]]-[2-Nal]-Aib-[Lys(Ac)]-NN-NH₂;

(SEQ ID NO: 606)
Ac-[Pen]-QTWQ-[Pen]-[Phe[4-(2-aminoethoxy)]]-[2-Nal]-[Aib]-[Lys(Ac)]-NQ-NH₂;

(SEQ ID NO: 613)
Ac-[Pen]-QTWQ-[Pen]-[Phe[4-(2-acetylaminoethoxy)]]-[2-Nal]-[α-MeLeu]-[Lys(Ac)]-NN-NH₂;

(SEQ ID NO: 614)
Ac-[Pen]-QTWQ-[Pen]-[Phe[4-(2-acetylaminoethoxy)]]-[2-Nal]-[α-MeLeu]-QNN-NH₂;

(SEQ ID NO: 639)
Ac-[Pen]-NTWQ-[Pen]-[Phe[4-(2-aminoethoxy)]]-[2-Nal]-[Aib]-[Lys(Ac)]-N-[βAla]-NH₂;

(SEQ ID NO: 641)
Ac-[Pen]-NTWQ-[Pen]-[Phe[4-(2-aminoethoxy)]]-[2-Nal]-[hLeu]-[Lys(Ac)]-N-[βAla]-NH₂;

(SEQ ID NO: 616)
Ac-[Pen]-QTWQ-[Pen]-[Phe[4-(2-acetylaminoethoxy)]]-[2-Nal]-[Aib]-[Lys(Ac)]-NN-NH₂;

(SEQ ID NO: 632)
Ac-[Pen]-NTWQ-[Pen]-[Phe[4-(2-aminoethoxy)]]-[2-Nal]-[Aib]-[Lys(Ac)]-NN-NH₂;

(SEQ ID NO: 617)
Ac-[Pen]-QTWQ-[Pen]-[Phe[4-(2-acetylaminoethoxy)]]-[2-Nal]-[Aib]-[Lys(Ac)]-NQ-NH₂;
or (SEQ ID NO: 623)
Ac-[Pen]-QTWQ-[Pen]-[Phe(4-OMe]-[2-Nal]-[Aib]-[Lys(Ac)]-NQ-NH₂, wherein the peptide inhibitor comprises a disulfide bond between the two Pen amino acids.

6. The peptide inhibitor of claim 1, wherein
X4 is Abu, 2-chloromethylbenzoic acid, mercapto-propanoic acid, mercapto-butyric acid, 2-chloro-acetic acid, 3-chloro-propanoic acid, 4-chloro-butyric acid, 3-chloro-isobutyric acid;
X9 is Abu, Cys, Pen, hCys, D-Pen, D-Cys, or D-hCys, and and the bond between X4 and X9 is a thioether bond.

7. The peptide inhibitor of claim 6, wherein
(a) X4 is Abu and X9 is Cys; or
(b) X4 is Cys and X9 is Abu;
wherein the peptide inhibitor is cyclized via a thioether bond between X4 and X9.

8. The peptide inhibitor of claim 6, wherein
X7 is Trp;
X10 is Phe, Tyr, a Phe analog, or a Tyr analog;
X11 is Trp, 1-Nal or 2-Nal; and X12 is α-Me-Lys, α-Me-Leu, α-Me-Ser, α-Me-Val, Achc, Acvc, Acpc, Acbc or 4-amino-4-carboxy-tetrahydropyran.

9. The peptide inhibitor of claim 8, wherein the peptide inhibitor comprises any of the following amino acid sequences:

```
                                        (SEQ ID NO: 430)
Ac-Cyclo-[[Abu]-QTWQC]]-[Phe(4-OMe)]-[2-Nal]-

[α-MeLys]-E-N-G;

(SEQ ID NO: 431)
Ac-Cyclo-[[Abu]-QTWQC]]-[Phe(4-OMe)]-[2-Nal]-

[α-MeOrn]-ENG-NH₂;

(SEQ ID NO: 432)
Ac-Cyclo-[[Abu]-QTWQC]]-[Phe(4-CO₂H)]-[2-Nal]-

[α-MeLys]-[Lys(Ac)]-NG-NH₂;

(SEQ ID NO: 433)
Ac-Cyclo-[[Abu]-QTWQC]]-[Phe(4-OMe)]-[2-Nal]-

[α-MeLys]-[Lys(Ac)]-NG-NH₂;

(SEQ ID NO: 434)
Ac-Cyclo-[[Abu]-QTWQC]]-[Phe(4-CONH₂)]-[2-Nal]-

[α-MeLys]-[Lys(Ac)]NG-NH₂;

(SEQ ID NO: 435)
Ac-Cyclo-[[Abu]-QTWQC]]-[Phe(4-OMe)]-[2-Nal]-

[α-MeLys]-[Lys(Ac)]-NA-NH₂;

(SEQ ID NO: 436)
Ac-Cyclo-[[Abu]-QTWQC]]-[Phe(4-OMe)]-[2-Nal]-

[α-MeLys]-[Lys(Ac)]-NAE-NH₂;

(SEQ ID NO: 437)
Ac-Cyclo-[[Abu]-QTWQC]]-[Phe[4-(2-aminoethoxy)]]-

[2-Nal]-[α-MeLys]-ENG-NH₂;

(SEQ ID NO: 438)
Ac-Cyclo-[[Abu]-QTWQC]]-[Phe[4-(2-aminoethoxy)]]-W-

[α-MeLys]-E-N-G;

(SEQ ID NO: 439)
Ac-Cyclo-[[Abu]-QTWQC]]-[Phe[4-(2-aminoethoxy)]]-

[2-Nal]-[α-MeLys]-DNG-NH₂;

(SEQ ID NO: 440)
Ac-Cyclo-[[Abu]-QTWQC]]-[Phe[4-(2-aminoethoxy)]]-

[2-Nal]-[α-MeLys]-[Lys(succinic acid)]-NG-NH₂;

(SEQ ID NO: 441)
Ac-Cyclo-[[Abu]-QTWQC]]-[Phe[4-(2-aminoethoxy)]]-

[2-Nal]-[α-MeLys]-[Lys(glutaric acid)]-NG-NH₂;

(SEQ ID NO: 442)
Ac-Cyclo-[[Abu]-QTWQC]]-[Phe[4-(2-aminoethoxy)]]-

[2-Nal]-[α-MeLys]-[Lys(pyroglutamic acid)]-NG-NH₂;

(SEQ ID NO: 443)
Ac-Cyclo-[[Abu]-QTWQC]]-[Phe[4-(2-aminoethoxy)]]-

[2-Nal]-[α-MeLys]-[Lys(isovaleric acid)]-NG-NH₂;

(SEQ ID NO: 444)
Ac-Cyclo-[[Abu]-QTWQC]]-[Phe[4-(2-aminoethoxy)]]-

[2-Nal]-[α-MeLys]-[Lys(Ac)]-NG-[(D)Lys]-NH₂;
```

-continued

```
                                        (SEQ ID NO: 445)
Ac-Cyclo-[[Abu]-QTWQC]]-[Phe[4-(2-aminoethoxy)]]-

[2-Nal]-[α-MeLys]-[Lys(Ac)]-NG-[AEA]-NH₂;

(SEQ ID NO: 446)
Ac-Cyclo-[[Abu]-QTWQC]]-[Phe[4-(2-aminoethoxy)]]-

[2-Nal]-[Aib]-QNG-NH₂;

(SEQ ID NO: 447)
Ac-Cyclo-[[Abu]-QTWQC]]-[Phe[4-(2-aminoethoxy)]]-

[2-Nal]-[Aib]-[Lys(Ac)]-NA-NH₂;

(SEQ ID NO: 448)
Ac-Cyclo-[[Abu]-QTWQC]]-[Phe[4-(2-aminoethoxy)]]-

[2-Nal]-[Aib]-KNG-NH₂;

(SEQ ID NO: 449)
Ac-Cyclo-[[Abu]-QTWQC]]-[Phe[4-(2-aminoethoxy)]]-

[2-Nal]-[α-MeLys]-[Lys(Ac)]-NG-NH₂;

(SEQ ID NO: 656)
Ac-Cyclo-[[Abu]-QTWQC]]-[Phe[4-(2-(acetylaminoethoxy)]]-[2-Nal]-[α-MeLys(Ac)]-

[Lys(Ac)]-NG-NH₂;

(SEQ ID NO: 657)
Ac-Cyclo-[[Abu]-QTWQC-[Phe[4-(2-(acetylaminoethoxy)]]-[2-Nal]-[α-MeLys(Ac)]-ENG-NH₂;

(SEQ ID NO: 658)
Ac-Cyclo-[[Abu]-QTWQC]]-[Phe[4-(2-aminoethoxy)]]-

[2-Nal]-[4-amino-4-carboxy-tetrahydropyran]-ENN-

NH₂;

(SEQ ID NO: 659)
Ac-Cyclo-[[Abu]-QTWQQ]]-[Phe[4-(2-aminoethoxy)]]-

[2-Nal]-[α-MeLys]-ENQ-NH₂;

(SEQ ID NO: 912)
Ac-Cyclo-[[Abu]-QTWQC]-[Phe[4-(2-aminoethoxy)]]-

[2-Nal]-[α-MeLys]-ENN-NH₂;

(SEQ ID NO: 660)
Ac-Cyclo-[[Abu]-QTWQC]]-[Phe[4-(2-aminoethoxy)]]-

[2-Nal]-[α-MeVal]-[Lys(Ac)]-NG-NH₂;

(SEQ ID NO: 661)
Ac-Cyclo-[[Abu]-QTWQC]]-[Phe[4-(2-aminoethoxy)]]-

[2-Nal]-[hLeu]-[Lys(Ac)]-N-[βAla]-NH₂;

(SEQ ID NO: 662)
Ac-Cyclo-[[Abu]-QTWQC]]-[Phe[4-(2-(acetylaminoethoxy)]]-[2-Nal]-[α-MeLys(Ac)]-ENQ-NH₂;

(SEQ ID NO: 663)
Ac-Cyclo-[[Abu]-QTWQC]]-[Phe[4-(2-(acetylaminoethoxy)]]-[2-Nal]-[α-MeLys(Ac)]-ENN-NH₂;

(SEQ ID NO: 664)
Ac-Cyclo-[[Abu]-QTWQC]]-[Phe[4-(2-aminoethoxy)]]-

[2-Nal]-[α-MeLeu]-ENN-NH₂;
```

-continued

Ac-Cyclo-[[Abu]-QTWQC]]-[Phe[4-(2-aminoethoxy)]]-[2-Nal]-[α-MeLeu]-[Cit]-NN-NH₂; (SEQ ID NO: 665)

Ac-Cyclo-[[Abu]-QTWQC]]-[Phe[4-(2-aminoethoxy)]]-[2-Nal]-[α-MeLeu]-[Lys(Ac)]-NN-NH₂; (SEQ ID NO: 766)

Ac-Cyclo-[[Abu]-QTWQC]]-[-Phe[4-(2-aminoethoxy)]]-[2-Nal]-[Aib]-[Lys(Ac)]-NG-NH₂; (SEQ ID NO: 767)

Ac-E-Cyclo-[[Abu]-QTWQC]-[Phe[4-(2-aminoethoxy)]]-[2-Nal]-[α-MeLys]-ENN-NH3; (SEQ ID NO: 965)

Ac-(D)Glu-[Cyclo-[[Abu]-QTWQC]-[Phe[4-(2-aminoethoxy)]]-[2-Nal]-[α-MeLys]-ENN-NH₂; (SEQ ID NO: 966)

Ac-Arg-Cyclo-[[Abu]-QTWQC]-[Phe[4-(2-aminoethoxy)]]-[2-Nal]-[α-MeLys]-ENN-NH₂; (SEQ ID NO: 967)

Ac-[(D)Arg-Cyclo-[[Abu]-QTWQC]-[Phe[4-(2-aminoethoxy)]]-[2-Nal]-[α-MeLys]-ENN-NH₂; (SEQ ID NO: 1041)

Ac-F-Cyclo-[[Abu]-QTWQC]]-[Phe[4-(2-aminoethoxy)]]-[2-Nal]-[α-MeLys]-ENN-NH₂; (SEQ ID NO: 969)

Ac-[(D)Phe]-Cyclo-[[Abu]-QTWQC]-[Phe[4-(2-aminoethoxy)]]-[2-Nal]-[α-MeLys]-ENN-NH₂; (SEQ ID NO: 970)

Ac-[2-Nal]-Cyclo-[[Abu]-QTWQC]-[Phe[4-(2-aminoethoxy)]]-[2-Nal]-[α-MeLys]-ENN-NH₂; (SEQ ID NO: 971)

Ac-Leu-Cyclo-[[Abu]-QTWQC]-[Phe[4-(2-aminoethoxy)]]-[2-Nal]-[α-MeLys]-ENN-NH₂; (SEQ ID NO: 973)

Ac-[(D)Gln]-Cyclo-[[Abu]-QTWQC]-[Phe[4-(2-aminoethoxy)]]-[2-Nal]-[α-MeLys]-ENN-NH₂; (SEQ ID NO: 1042)

Ac-Cyclo-[[Abu]-QTWQC]]-[Phe[4-(2-aminoethoxy)]]-[2-Nal]-[α-MeLeu]-ENG-NH₂; (SEQ ID NO: 842)

Ac-T-Cyclo-[[Abu]-QTWQC]]-[Phe[4-(2-aminoethoxy)]]-[2-Nal]-[α-MeLys]-ENN-NH₂; (SEQ ID NO: 972)

Ac-Cyclo-[[Abu]-QTWQC]]-[Phe[4-(2-aminoethoxy)]]-[2-Nal]-[α-MeLeu]-QN-[βAla]-NH₂; (SEQ ID NO: 752)

Ac-Cyclo-[[Abu]-QTWQC]]-[Phe[4-(2-aminoethoxy)]]-[2-Nal]-[Acbc]-ENN-NH₂; (SEQ ID NO: 753)

Ac-Cyclo-[[Abu]-QTWQC]]-[Phe[4-(2-aminoethoxy)]]-[2-Nal]-[Achc]-ENN-NH₂; (SEQ ID NO: 754)

Ac-Cyclo-[[Abu]-QTWQC]]-[Phe[4-(2-aminoethoxy)]]-[2-Nal]-[Acvc]-ENN-NH₂; (SEQ ID NO: 755)

Ac-Cyclo-[[Abu]-QTWQC]]-[Phe[4-(2-aminoethoxy)]]-[2-Nal]-[4-amino-4-carboxy-piperidine]-ENN-NH₂; (SEQ ID NO: 979)

Ac-[(D)Arg]-Cyclo-[[Abu]-QTWQC]]-[Phe[4-(2-aminoethoxy)]]-[2-Nal]-[4-amino-4-carboxy-tetrahydropyran]-ENN-NH₂; (SEQ ID NO: 993)

or

Ac-Cyclo-[[Abu]-QTWQC]]-[Phe[4-(2-aminoethoxy)]]-[2-Nal]-[4-amino-4-carboxy-tetrahydropyran]-ENN-NH₂, (SEQ ID NO: 980)

wherein the peptide inhibitor comprises a thioether bond between the Abu and the C.

10. The peptide inhibitor of claim 1, wherein the peptide inhibitor comprises the structure of Formula I:

$$R^1-X-R^2 \qquad (I)$$

or a pharmaceutically acceptable salt or solvate thereof, wherein $R^1$ is a bond, hydrogen, a C1-C6 alkyl, a C6-C12 aryl, a C6-C12 aryl, a C1-C6 alkyl, a C1-C20 alkanoyl, and including PEGylated versions alone or as spacers of any of the foregoing; X is the amino acid sequence; and $R^2$ is OH or $NH_2$.

11. A peptide inhibitor of an interleukin-23 receptor, or a pharmaceutically acceptable salt or solvate thereof, wherein the peptide inhibitor comprises the amino acid sequence of Formula Xa:

X1-X2-X3-X4-X5-X6-X7-X8-X9-X10-X11-X12-X13-X14-X15-X16-X17-X18-X19-X20 (Xa)

wherein

X1 is any amino acid or absent;
X2 is any amino acid or absent;
X3 is any amino acid or absent;
X4 is Pen, Cys or homo-Cys;
X5 is any amino acid;
X6 is any amino acid;
X7 is Trp, Bip, Gln, His, Glu(Bzl), 4-Phenylbenzylalanine, Tic, Phe[4-(2-aminoethoxy)], Phe(3,4-Cl₂), Phe(4-OMe), 5-Hydroxy-Trp, 6-Chloro-Trp, N-MeTrp, α-Me-Trp, 1,2,3,4-tetrahydro-norharman, Phe(4-CO₂H), Phe(4-CONH₂), Phe(3,4-Dimethoxy), Phe(4-CF₃), Phe(4-tBu), ββ-diPheAla, Glu, Gly, Ile, Asn, Pro, Arg, Thr or Octgly, or a corresponding α-methyl amino acid form of any of the foregoing;
X8 is any amino acid;
X9 is Pen, Cys or hCys;
X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly, a Phe analog or a Tyr analog, or a corresponding α-methyl amino acid form of any of the foregoing;
X11 is 2-Nal, 1-Nal, 2,4-dimethylPhe, Bip, Phe(3,4-Cl₂), Phe (3,4-F₂), Phe(4-CO₂H), βhPhe(4-F), α-Me-Trp, 4-phenylcyclohexyl, Phe(4-CF₃), α-MePhe, βhPhe, βhTyr, βhTrp, Nva(5-phenyl), Phe, His, hPhe, Tic, Tqa, Trp, Tyr, Phe(4-OMe), Phe(4-Me), Trp(2,5,7-tri-tert-Butyl), Phe(4-Oallyl), Tyr(3-tBu), Phe(4-tBu), Phe(4-guanidino), Phe(4-OBzl), Octgly, Glu(Bzl), 4-Phenylbenzylalanine, Phe[4-(2-aminoethoxy)], 5-Hydroxy-Trp, 6-Chloro-Trp, N-MeTrp, 1,2,3,4-tetrahydronorharman, Phe(4-CONH₂), Phe(3,4-OMe₂) Phe(2,3-Cl₂), Phe(2,3-F₂), Phe(4-F), 4-phenylcyclohexylalanine or Bip, or a corresponding α-methyl amino acid form of any of the foregoing;

X12 is α-MeLys, α-MeOrn, α-MeLeu, α-MeVal, 4-amino-4-carboxy-tetrahydropyran, Achc Acpc, Acbc, Acvc, MeLeu, Aib, (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-diethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing;

X13 is Lys(Ac), (D)Asn, (D)Leu, (D)Thr, (D)Phe, Ala, Aib, α-MeLeu, β-Ala, βhGlu, βhAla, βhLeu, βhVal, β-spiro-pip, Cha, Chg, Asp, Lys, Arg, Orn, Dab, Dap, α-diethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing;

X14 is Asn, Glu, Phe, Gly, His, Lys, Leu, Met, Asn, Pro, Gln, Arg, Ser, Thr, Tic or Tyr, Lys(Ac), Orn or a corresponding α-methyl amino acid form of any of the foregoing;

X15 is Gly, (D)Ala, (D)Asn, (D)Asp, Asn, (D)Leu, (D)Phe, (D)Thr, Ala, Asn, Ser, AEA, Asp, Glu, Phe, Gly, Lys, Leu, Pro, Gln, Arg or Ser, β-Ala, Arg or a corresponding α-methyl amino acid form of any of the foregoing;

X16 is absent, Gly, Ala, Asp, Ser, Pro, Asn or Thr, or a corresponding α-methyl amino acid form of any of the foregoing;

X17 is absent, Glu, Ser, Gly or Gln, or a corresponding α-methyl amino acid form of any of the foregoing;

X18 is absent or any amino acid;

X19 is absent or any amino acid; and

X20 is absent or any amino acid, wherein the peptide inhibitor comprises a disulfide bond between X4 and X9.

12. The peptide inhibitor of claim 11, wherein both X4 and X9 are Pen.

13. The peptide inhibitor of claim 11, wherein X18 is (D)-Lys.

14. The peptide inhibitor of claim 11, comprising one or more, two or more, three or more, or four of the following:
X5 is Arg, Asn, Gln, Dap, Orn;
X6 is Thr or Ser;
and
X8 is Gln, Val, Phe, Glu, Lys.

15. The peptide inhibitor of claim 11, comprising one or more, two or more, three or more, four or more, five or more, six or more, or seven of the following:
X10 is Tyr or a Phe analog;
X11 is Trp, 2-Nal, 1-Nal, Phe(4-OAllyl), Tyr(3-tBu), Phe(4-tBu), Phe(4-guanidino), Phe(Bzl) or Phe(4-Me), 5-Hydroxy-Trp, 6-Chloro-Trp, N-MeTrp, α-MeTrp or 1,2,3,4-tetrahydro-norharman;
X12 is Arg, α-MeLys α-MeLeu, Aib or α-MeOrn;
X13 is Lys, Glu or Lys(Ac);
X14 is Phe or Asn;
X15 is Asn, Gly, Ser, or βAla; and
X16 is absent.

16. The peptide inhibitor of claim 15, wherein X4 and X9 are Pen; X5 is Gln; X6 is Thr; X7 is Trp; X8 is Gln; X10 is Tyr or a Phe analog; X11 is Trp, 2-Nal or 1-Nal; X12 is Arg, αMeLys or α-MeOrn; X13 is Lys, Glu or Lys(Ac); X14 is Phe or Asn; X15 is Gly; and X16 is absent.

17. The peptide inhibitor of claim 11, wherein the Phe analog is Phe(3,4-F₂), Phe(3,4-Cl₂), Phe(3-Me), Phe[4-(2-aminoethoxy)], Phe[4-(2-(acetyl-aminoethoxy)], Phe(4-Br), Phe(4-CONH₂), Phe(4-Cl), Phe(4-CN), Phe(4-guanidino), Phe(4-Me), Phe(4-NH₂), Phe(4-N₃), Phe(4-OMe), or Phe(4-OBzl).

18. The peptide inhibitor of claim 15, wherein the Phe analog is Phe(4-OBzl), Phe(4-OMe), Phe(4-CONH₂), Phe (3,4-Cl₂), Phe(4-tBu), Phe(4-NH₂), Phe(4-Br), Phe(4-CN), Phe(4-CO₂H), Phe(4-(2aminoethoxy)) or Phe(4-guanidino).

19. A peptide inhibitor of an interleukin-23 receptor, or a pharmaceutically acceptable salt or solvate thereof, wherein the peptide inhibitor comprises the amino acid sequence of Formula Xa:

X1-X2-X3-X4-X5-X6-X7-X8-X9-X10-X11-X12-X13-X14-X15-X16-X17-X18-X19-X20      (Xa)

wherein
X1 is any amino acid or absent;
X2 is any amino acid or absent;
X3 is any amino acid or absent;
X4 is Abu, Pen, or Cys;
X5 is any amino acid or absent;
X6 is any amino acid or absent;
X7 is Trp, Bip, Gln, His, Glu(Bzl), 4-Phenylbenzylalanine, Tic, Phe[4-(2-aminoethoxy)], Phe(3,4-Cl₂), Phe (4-OMe), 5-Hydroxy-Trp, 6-Chloro-Trp, N-MeTrp, α-MeTrp, 1,2,3,4-tetrahydro-norharman, Phe(4-CO₂H), Phe(4-CONH₂), Phe(3,4-Dimethoxy), Phe(4-CF₃), ββ-diPheAla, Phe(4-tBu), Glu, Gly, Ile, Asn, Pro, Arg, Thr or Octgly, or a corresponding α-methyl amino acid form of any of the foregoing;
X8 is any amino acid or absent;
X9 is Abu, Pen, or Cys;
X10 is 1-Nal, 2-Nal, Aic, Bip, (D)Cys, Cha, DMT, (D)Tyr, Glu, Phe, His, Trp, Thr, Tic, Tyr, 4-pyridylAla, Octgly a Phe analog or a Tyr analog, or a corresponding α-methyl amino acid form of any of the foregoing;
X11 is 2-Nal, 1-Nal, 2,4-dimethylPhe, Bip, 4-phenylcyclohexyl, Glu(Bzl), 4-Phenylbenzylalanine, Tic, Phe[4-(2-aminoethoxy)], Phe(3,4-Cl₂), Phe(3,4-F₂), βhPhe(4-F), Phe(4-OMe), 5-Hydroxy-Trp, 6-Chloro-Trp, N-MeTrp, α-MeTrp, 1,2,3,4-tetrahydro-norharman, Phe(4-CO₂H), Phe(4-CONH₂), Phe(3,4-Dimethoxy), Phe(4-CF₃), Phe(2,3-Cl₂), Phe(2,3-F₂), Phe(4-F), 4-phenylcyclohexylalanine, α-MePhe, βhPhe, βhTyr, βhTrp, Bip, Nva(5-phenyl), Phe, His, hPhe, Tqa, Trp, Tyr, Phe(4-Me), Trp(2,5,7-tri-tertButyl), Phe(4-OAllyl), Tyr(3-tBu), Phe(4-tBu), Phe(4-guanidino), Phe(4-OBzl), or Octgly, or a corresponding α-methyl amino acid form of any of the foregoing;
X12 is α-MeLys, α-MeOrn, α-MeLeu, MeLeu, Aib, Achc, Acvc, Acpc, 4 amino-4-carboxy-tetrahydropyran (THP), (D)Ala, (D)Asn, (D)Leu, (D)Asp, (D)Phe, (D)Thr, 3-Pal, Aib, β-Ala, βhGlu, βhAla, βhLeu, βhVal, β-spiro-pip, Cha, Chg, Asp, Dab, Dap, α-DiethylGly, Glu, Phe, hLeu, hArg, hLeu, Ile, Lys, Leu, Asn, N-MeLeu, N-MeArg, Ogl, Orn, Pro, Gln, Arg, Ser, Thr or Tle, or a corresponding α-methyl amino acid form of any of the foregoing;
X13 is Lys(Ac), (D)Asn, (D)Leu, (D)Thr, (D)Phe, Ala, Aib, α-MeLeu, βAla, βhGlu, βhAla, βhLeu, βhVal, β-spiro-pip, Cha, Chg, Asp, Arg, Orn, Dab, Dap, α-DiethylGly, Glu, Phe, hLeu, Lys, Leu, Asn, Ogl, Pro, Gln, Asp, Arg, Ser, spiro-pip, Thr, Tba, Tlc, Val or Tyr, or a corresponding α-methyl amino acid form of any of the foregoing;

X14 is Asn, Glu, Phe, Gly, His, Lys, Leu, Met, Asn, Pro, Gln, Arg, Ser, Thr, Tic or Tyr, or a corresponding α-methyl amino acid form of any of the foregoing;

X15 is Gly, (D)Ala, (D)Asn, (D)Asp, Asn, (D)Leu, (D)Phe, (D)Thr, Ala, (2-aminoethoxy)acetic acid (AEA), Asp, Glu, Phe, Gly, Lys, Leu, Pro, Gln, Arg or Ser, or a corresponding α-methyl amino acid form of any of the foregoing;

X16 is absent, Gly, Ala, Asp, Ser, Pro, Asn or Thr, or a corresponding α-methyl amino acid form of any of the foregoing; and X17 is absent, Glu, Ser, Gly or Gln, or a corresponding α-methyl amino acid form of any of the foregoing, wherein the peptide inhibitor is cyclized via an intramolecular bond between X4 and X9.

20. The peptide inhibitor of claim 19, wherein X4 or X9 is Abu.

21. The peptide inhibitor of claim 19, comprising one or more, two or more, or three of the following:
X5 is Arg, Gln, Dap or Orn;
X6 is Thr or Ser;
and
X8 is Gln, Val, Phe, Glu or Lys.

22. The peptide inhibitor of claim 19, comprising one or more, two or more, three or more, four or more, five or more, six or more, or seven of the following:

X10 is Tyr; or a Phe analog;

X11 is Trp, 2-Nal, 1-Nal, Phe(4-OAllyl), Tyr(3-tBu), Phe(4-tBu), Phe(4-guanidino), Phe(4-OMe), 5-Hydroxy-Trp, 6-Chloro-Trp, N-MeTrp, α-MeTrp or 1,2,3,4-tetrahydro-norharman;

X12 is Arg, hLeu, (D)Asn, Aib, α-MeLys, α-MeLeu, α-MeOrn, Achc, Acvc, Acpc, Acpc, or THP;

X13 is Lys, Glu or Lys(Ac);

X14 is Phe or Asn;

X15 is Gly, Ser, Asn, or Ala; and

X16 is absent.

23. The peptide inhibitor of claim 22, wherein the Phe analog is Phe(4-OBzl), Phe(4-OMe), Phe(4-CONH$_2$), Phe(3,4-Cl$_2$), Phe(4-tBu), Phe(4-NH$_2$), Phe(4-Br), Phe(4-CN), Phe(4-CO$_2$H), Phe(4-(2aminoethoxy)) or Phe(4-guanadino).

24. A pharmaceutical composition comprising the peptide inhibitor of any one of claims 1, 2-5, 6-11, 12-16, 19 or 10-20, and a pharmaceutically acceptable carrier, excipient, or diluent.

* * * * *